US010253067B2

(12) United States Patent
Chen et al.

(10) Patent No.: US 10,253,067 B2
(45) Date of Patent: Apr. 9, 2019

(54) PEPTIDOMIMETIC MACROCYCLES AND USES THEREOF

(71) Applicant: AILERON THERAPEUTICS, INC., Cambridge, MA (US)

(72) Inventors: Hubert Chen, San Diego, CA (US); David Allen Annis, Cambridge, MA (US); Yong Chang, Acton, MA (US); Manuel Aivado, Chester Springs, PA (US); Karen Olson, Waltham, MA (US); Chris Viau, Mashpee, MA (US)

(73) Assignee: Aileron Therapeutics, Inc., Watertown, MA (US)

( * ) Notice: Subject to any disclaimer, the term of this patent is extended or adjusted under 35 U.S.C. 154(b) by 136 days.

(21) Appl. No.: 15/074,794

(22) Filed: Mar. 18, 2016

(65) Prior Publication Data

US 2016/0333049 A1    Nov. 17, 2016

Related U.S. Application Data

(60) Provisional application No. 62/232,275, filed on Sep. 24, 2015, provisional application No. 62/136,357, filed on Mar. 20, 2015.

(51) Int. Cl.
| | | |
|---|---|---|
| *C07K 7/06* | (2006.01) | |
| *A61K 38/12* | (2006.01) | |
| *C07K 7/08* | (2006.01) | |
| *A61K 38/00* | (2006.01) | |

(52) U.S. Cl.
CPC ............... *C07K 7/06* (2013.01); *A61K 38/12* (2013.01); *C07K 7/08* (2013.01); *A61K 38/00* (2013.01)

(58) Field of Classification Search
CPC .............. A61K 45/06; A61K 39/39558; A61K 31/198; A61K 38/00; A61K 2039/585; A61K 31/277; A61K 35/763; C12Q 1/6886; G01N 33/57426; C12N 2310/3513; C07K 16/18; C07K 2319/70
See application file for complete search history.

(56) References Cited

U.S. PATENT DOCUMENTS

| | | |
|---|---|---|
| 4,000,259 A | 12/1976 | Garsky |
| 4,191,754 A | 3/1980 | Nutt et al. |
| 4,270,537 A | 6/1981 | Romaine |
| 4,438,270 A | 3/1984 | Bey et al. |
| 4,518,586 A | 5/1985 | Rivier et al. |
| 4,596,556 A | 6/1986 | Morrow et al. |
| 4,683,195 A | 7/1987 | Mullis et al. |
| 4,683,202 A | 7/1987 | Mullis |
| 4,728,726 A | 3/1988 | Rivier et al. |
| 4,730,006 A | 3/1988 | Bohme et al. |
| 4,737,465 A | 4/1988 | Bond et al. |
| 4,790,824 A | 12/1988 | Morrow et al. |
| 4,880,778 A | 11/1989 | Bowers et al. |
| 4,886,499 A | 12/1989 | Cirelli et al. |
| 4,940,460 A | 7/1990 | Casey et al. |
| 4,941,880 A | 7/1990 | Burns |
| 5,015,235 A | 5/1991 | Crossman |
| 5,036,045 A | 7/1991 | Thorner |
| 5,043,322 A | 8/1991 | Rivier et al. |
| 5,064,413 A | 11/1991 | McKinnon et al. |
| 5,094,951 A | 3/1992 | Rosenberg |
| 5,112,808 A | 5/1992 | Coy et al. |
| 5,120,859 A | 6/1992 | Webb |
| 5,141,496 A | 8/1992 | Dalto et al. |
| 5,169,932 A | 12/1992 | Hoeger et al. |
| 5,190,521 A | 3/1993 | Hubbard et al. |
| 5,245,009 A | 9/1993 | Kornreich et al. |
| 5,262,519 A | 11/1993 | Rivier et al. |
| 5,296,468 A | 3/1994 | Hoeger et al. |
| 5,310,910 A | 5/1994 | Drtina et al. |
| 5,312,335 A | 5/1994 | McKinnon et al. |
| 5,323,907 A | 6/1994 | Kalvelage |
| 5,328,483 A | 7/1994 | Jacoby |
| 5,334,144 A | 8/1994 | Alchas et al. |
| 5,339,163 A | 8/1994 | Homma et al. |
| 5,352,796 A | 10/1994 | Hoeger et al. |
| 5,364,851 A | 11/1994 | Joran |
| 5,371,070 A | 12/1994 | Koerber et al. |
| 5,383,851 A | 1/1995 | McKinnon, Jr. et al. |
| 5,384,309 A | 1/1995 | Barker et al. |
| 5,416,073 A | 5/1995 | Coy et al. |

(Continued)

FOREIGN PATENT DOCUMENTS

| | | |
|---|---|---|
| AU | 2008232709 A1 | 10/2008 |
| CA | 2700925 A1 | 4/2009 |

(Continued)

OTHER PUBLICATIONS

Zhu et al. Mechanisms of relapse in acute leukaemia: involvement of p53 mutated subclones in disease progression in acute lymphoblastic leukaemia. Br J Cancer. Mar. 1999;79(7-8):1151-7. (Year: 1999).*
Crook et al. Degradation of p53 can be targeted by HPV E6 sequences distinct from those required for p53 binding and trans-activation. Cell. Nov. 1, 1991;67(3):547-56. (Year: 1991).*
Nahi et al. Mutated and non-mutated TP53 as targets in the treatment of leukaemia. British Journal of Haematology. 2008; 141: 445-453. (Year: 2008).*
Co-pending U.S. Appl. No. 15/711,576, filed Sep. 21, 2017.
Co-pending U.S. Appl. No. 15/794,355, filed Oct. 26, 2017.
Chang et al., Transactivation of miR-34a by p53 broadly influences gene expression and promotes apoptosis.Mol. Cell., 26(5):745-752, 2007.

(Continued)

*Primary Examiner* — Marcela M Cordero Garcia
*Assistant Examiner* — Jia-Hai Lee
(74) *Attorney, Agent, or Firm* — Wilson Sonsini Goodrich & Rosati

(57) ABSTRACT

Methods for treating liquid cancer, determined to lack a p53 deactivation mutation, in a subject are provided. Also provided are peptidomimetic macrocycles for use in treatment of a liquid cancer, determined to lack a p53 deactivation mutation, in a subject.

84 Claims, 6 Drawing Sheets
Specification includes a Sequence Listing.

(56) References Cited

U.S. PATENT DOCUMENTS

| | | |
|---|---|---|
| 5,417,662 A | 5/1995 | Hjertman et al. |
| 5,446,128 A | 8/1995 | Kahn |
| 5,453,418 A | 9/1995 | Anderson et al. |
| 5,466,220 A | 11/1995 | Brenneman |
| 5,480,381 A | 1/1996 | Weston |
| 5,503,627 A | 4/1996 | McKinnon et al. |
| 5,506,207 A | 4/1996 | Rivier et al. |
| 5,520,639 A | 5/1996 | Peterson et al. |
| 5,527,288 A | 6/1996 | Gross et al. |
| 5,552,520 A | 9/1996 | Kim et al. |
| 5,569,189 A | 10/1996 | Parsons |
| 5,580,957 A | 12/1996 | Hoeger et al. |
| 5,599,302 A | 2/1997 | Lilley et al. |
| 5,620,708 A | 4/1997 | Amkraut et al. |
| 5,622,852 A | 4/1997 | Korsmeyer |
| 5,629,020 A | 5/1997 | Leone-Bay et al. |
| 5,635,371 A | 6/1997 | Stout et al. |
| 5,643,957 A | 7/1997 | Leone-Bay et al. |
| 5,649,912 A | 7/1997 | Peterson |
| 5,650,133 A | 7/1997 | Carvalho et al. |
| 5,650,386 A | 7/1997 | Leone-Bay et al. |
| 5,656,721 A | 8/1997 | Albert et al. |
| 5,663,316 A | 9/1997 | Xudong |
| 5,672,584 A | 9/1997 | Borchardt et al. |
| 5,681,928 A | 10/1997 | Rivier et al. |
| 5,700,775 A | 12/1997 | Gutniak et al. |
| 5,702,908 A | 12/1997 | Picksley et al. |
| 5,704,911 A | 1/1998 | Parsons |
| 5,708,136 A | 1/1998 | Burrell et al. |
| 5,710,245 A | 1/1998 | Kahn |
| 5,710,249 A | 1/1998 | Hoeger et al. |
| 5,731,408 A | 3/1998 | Hadley et al. |
| 5,744,450 A | 4/1998 | Hoeger et al. |
| 5,750,499 A | 5/1998 | Hoeger et al. |
| 5,750,767 A | 5/1998 | Carpino et al. |
| 5,756,669 A | 5/1998 | Bischoff et al. |
| 5,770,377 A | 6/1998 | Picksley et al. |
| 5,792,747 A | 8/1998 | Schally et al. |
| 5,807,983 A | 9/1998 | Jiang et al. |
| 5,811,515 A | 9/1998 | Grubbs et al. |
| 5,817,752 A | 10/1998 | Yu |
| 5,817,789 A | 10/1998 | Heartlein et al. |
| 5,824,483 A | 10/1998 | Houston, Jr. et al. |
| 5,834,209 A | 11/1998 | Korsmeyer |
| 5,837,845 A | 11/1998 | Hosokawa et al. |
| 5,840,833 A | 11/1998 | Kahn |
| 5,846,936 A | 12/1998 | Felix et al. |
| 5,847,066 A | 12/1998 | Coy et al. |
| 5,854,216 A | 12/1998 | Gaudreau |
| 5,856,445 A | 1/1999 | Korsmeyer |
| 5,859,184 A | 1/1999 | Kahn et al. |
| 5,861,379 A | 1/1999 | Ibea et al. |
| 5,874,529 A | 2/1999 | Gilon et al. |
| 5,893,397 A | 4/1999 | Peterson et al. |
| 5,922,863 A | 7/1999 | Grubbs et al. |
| 5,939,386 A | 8/1999 | Ibea et al. |
| 5,939,387 A | 8/1999 | Broderick et al. |
| 5,955,593 A | 9/1999 | Korsmeyer |
| 5,965,703 A | 10/1999 | Horne et al. |
| 5,993,412 A | 11/1999 | Deily et al. |
| 5,998,583 A | 12/1999 | Korsmeyer |
| 6,020,311 A | 2/2000 | Brazeau et al. |
| 6,030,997 A | 2/2000 | Eilat et al. |
| 6,031,073 A | 2/2000 | Yu |
| 6,043,339 A | 3/2000 | Lin et al. |
| 6,046,289 A | 4/2000 | Komazawa et al. |
| 6,051,513 A | 4/2000 | Kumazawa et al. |
| 6,051,554 A | 4/2000 | Hornik et al. |
| 6,054,556 A | 4/2000 | Huby et al. |
| 6,060,513 A | 5/2000 | Leone-Bay et al. |
| 6,066,470 A | 5/2000 | Nishimura et al. |
| 6,071,510 A | 6/2000 | Leone-Bay et al. |
| 6,071,538 A | 6/2000 | Milstein et al. |
| 6,071,926 A | 6/2000 | Van et al. |
| 6,090,958 A | 7/2000 | Leone-Bay et al. |
| 6,100,298 A | 8/2000 | Leone-Bay et al. |
| 6,118,010 A | 9/2000 | Ueda et al. |
| 6,123,964 A | 9/2000 | Asgharnejad et al. |
| 6,127,341 A | 10/2000 | Hansen et al. |
| 6,127,354 A | 10/2000 | Peschke et al. |
| 6,127,391 A | 10/2000 | Hansen et al. |
| 6,153,391 A | 11/2000 | Picksley et al. |
| 6,169,073 B1 | 1/2001 | Halazonetis et al. |
| 6,177,076 B1 | 1/2001 | Lattime et al. |
| 6,177,542 B1 | 1/2001 | Ruoslahti et al. |
| 6,184,344 B1 | 2/2001 | Kent et al. |
| 6,190,699 B1 | 2/2001 | Luzzi et al. |
| 6,194,384 B1 | 2/2001 | Brazeau et al. |
| 6,194,402 B1 | 2/2001 | Bach et al. |
| 6,204,361 B1 | 3/2001 | Carpino et al. |
| 6,245,359 B1 | 6/2001 | Milstein et al. |
| 6,245,886 B1 | 6/2001 | Halazonetis et al. |
| 6,248,358 B1 | 6/2001 | Bologna et al. |
| 6,271,198 B1 | 8/2001 | Braisted et al. |
| 6,274,584 B1 | 8/2001 | Peschke et al. |
| 6,287,787 B1 | 9/2001 | Houghten et al. |
| 6,307,017 B1 | 10/2001 | Coy et al. |
| 6,309,859 B1 | 10/2001 | Nishimura et al. |
| 6,313,088 B1 | 11/2001 | Leone-Bay et al. |
| 6,313,133 B1 | 11/2001 | Van et al. |
| 6,326,354 B1 | 12/2001 | Gross et al. |
| 6,331,318 B1 | 12/2001 | Milstein |
| 6,344,213 B1 | 2/2002 | Leone-Bay et al. |
| 6,346,264 B1 | 2/2002 | White |
| 6,348,558 B1 | 2/2002 | Harris et al. |
| 6,368,617 B1 | 4/2002 | Hastings et al. |
| 6,420,118 B1 | 7/2002 | Halazonetis et al. |
| 6,420,136 B1 | 7/2002 | Riabowol et al. |
| 6,444,425 B1 | 9/2002 | Reed et al. |
| 6,458,764 B1 | 10/2002 | Gravel et al. |
| 6,461,634 B1 | 10/2002 | Marshall |
| 6,495,589 B2 | 12/2002 | Hay et al. |
| 6,495,674 B1 | 12/2002 | Lemke et al. |
| 6,514,685 B1 | 2/2003 | Moro |
| 6,548,501 B2 | 4/2003 | Hakkinen |
| 6,555,156 B1 | 4/2003 | Loughman |
| 6,555,570 B2 | 4/2003 | Hansen et al. |
| 6,569,993 B1 | 5/2003 | Sledeski et al. |
| 6,572,856 B1 | 6/2003 | Taylor et al. |
| 6,579,967 B1 | 6/2003 | Rivier et al. |
| 6,610,657 B1 | 8/2003 | Goueli |
| 6,613,874 B1 | 9/2003 | Mazur et al. |
| 6,617,360 B1 | 9/2003 | Bailey et al. |
| 6,620,808 B2 | 9/2003 | Van et al. |
| 6,635,740 B1 | 10/2003 | Enright et al. |
| 6,641,840 B2 | 11/2003 | Am et al. |
| 6,686,148 B1 | 2/2004 | Shen et al. |
| 6,696,063 B1 | 2/2004 | Torres |
| 6,696,418 B1 | 2/2004 | Hay et al. |
| 6,703,382 B2 | 3/2004 | Wang et al. |
| 6,713,280 B1 | 3/2004 | Huang et al. |
| 6,720,330 B2 | 4/2004 | Hay et al. |
| 6,747,125 B1 | 6/2004 | Hoeger et al. |
| 6,784,157 B2 | 8/2004 | Halazonetis et al. |
| 6,849,428 B1 | 2/2005 | Evans et al. |
| 6,852,722 B2 | 2/2005 | Hakkinen |
| 6,875,594 B2 | 4/2005 | Muir et al. |
| 6,897,286 B2 | 5/2005 | Jaspers et al. |
| 6,936,586 B1 | 8/2005 | Larsen et al. |
| 6,939,880 B2 | 9/2005 | Hansen et al. |
| 7,019,109 B2 | 3/2006 | Rivier et al. |
| 7,034,050 B2 | 4/2006 | Deghenghi |
| 7,064,193 B1 | 6/2006 | Cory et al. |
| 7,083,983 B2 | 8/2006 | Lane et al. |
| 7,084,244 B2 | 8/2006 | Gilon et al. |
| 7,115,372 B2 | 10/2006 | Shen et al. |
| 7,144,577 B2 | 12/2006 | Torres |
| 7,166,461 B2 | 1/2007 | Schwartz et al. |
| 7,183,059 B2 | 2/2007 | Verdine et al. |
| 7,189,801 B2 | 3/2007 | Halazonetis et al. |
| 7,192,713 B1 | 3/2007 | Verdine et al. |
| 7,202,332 B2 | 4/2007 | Arora et al. |
| 7,238,775 B2 | 7/2007 | Rivier et al. |
| 7,247,700 B2 | 7/2007 | Korsmeyer et al. |

(56) References Cited

U.S. PATENT DOCUMENTS

| | | |
|---|---|---|
| 7,268,113 B2 | 9/2007 | Bridon et al. |
| 7,312,304 B2 | 12/2007 | Coy et al. |
| 7,316,997 B2 | 1/2008 | Abribat et al. |
| 7,414,107 B2 | 8/2008 | Larsen et al. |
| 7,425,542 B2 | 9/2008 | Maggio |
| 7,445,919 B2 | 11/2008 | Jaspers et al. |
| 7,476,653 B2 | 1/2009 | Hoveyda et al. |
| 7,485,620 B2 | 2/2009 | Ghigo et al. |
| 7,491,695 B2 | 2/2009 | Fraser et al. |
| 7,521,420 B2 | 4/2009 | Fraser et al. |
| 7,538,190 B2 | 5/2009 | Robinson et al. |
| 7,566,777 B2 | 7/2009 | Enright et al. |
| 7,638,138 B2 | 12/2009 | Oki et al. |
| 7,655,447 B2 | 2/2010 | Jaspers et al. |
| 7,666,983 B2 | 2/2010 | Halazonetis et al. |
| 7,705,118 B2 | 4/2010 | Arora et al. |
| 7,723,469 B2 | 5/2010 | Walensky et al. |
| 7,737,174 B2 | 6/2010 | Wang et al. |
| 7,745,573 B2 | 6/2010 | Robinson et al. |
| 7,759,383 B2 | 7/2010 | Wang et al. |
| 7,786,072 B2 | 8/2010 | Verdine et al. |
| 7,829,724 B2 | 11/2010 | Perrissoud et al. |
| RE42,013 E | 12/2010 | Hoveyda |
| 7,884,073 B2 | 2/2011 | Guyon et al. |
| 7,884,107 B2 | 2/2011 | Ma et al. |
| 7,888,056 B2 | 2/2011 | Sheppard et al. |
| 7,893,025 B2 | 2/2011 | Lussier et al. |
| 7,893,278 B2 | 2/2011 | Haley et al. |
| 7,927,813 B2 | 4/2011 | Geneste et al. |
| 7,932,397 B2 | 4/2011 | Hock et al. |
| 7,960,342 B2 | 6/2011 | Rivier et al. |
| 7,960,506 B2 | 6/2011 | Nash |
| 7,964,724 B2 | 6/2011 | Fotouhi et al. |
| 7,981,998 B2 | 7/2011 | Nash |
| 7,981,999 B2 | 7/2011 | Nash |
| RE42,624 E | 8/2011 | Fraser |
| 7,994,329 B2 | 8/2011 | Andersen et al. |
| 7,998,927 B2 | 8/2011 | Maggio |
| 7,998,930 B2 | 8/2011 | Guyon et al. |
| 8,017,607 B2 | 9/2011 | Bartkovitz et al. |
| 8,039,456 B2 | 10/2011 | Polvino et al. |
| 8,039,457 B2 | 10/2011 | Polvino |
| 8,058,269 B2 | 11/2011 | Chen et al. |
| 8,071,541 B2 | 12/2011 | Arora et al. |
| 8,076,290 B2 | 12/2011 | Maggio |
| 8,076,482 B2 | 12/2011 | Chen et al. |
| 8,084,022 B2 | 12/2011 | Maggio |
| 8,088,733 B2 | 1/2012 | Fraser et al. |
| 8,088,815 B2 | 1/2012 | Bartkovitz et al. |
| 8,088,931 B2 | 1/2012 | Wang et al. |
| 8,124,356 B2 | 2/2012 | Sheppard et al. |
| 8,124,726 B2 | 2/2012 | Robinson et al. |
| 8,129,561 B2 | 3/2012 | Marsault et al. |
| 8,133,863 B2 | 3/2012 | Maggio |
| 8,173,594 B2 | 5/2012 | Maggio |
| 8,192,719 B2 | 6/2012 | Larsen |
| 8,198,405 B2 | 6/2012 | Walensky et al. |
| 8,217,051 B2 | 7/2012 | Zhang et al. |
| 8,222,209 B2 | 7/2012 | Guyon et al. |
| 8,226,949 B2 | 7/2012 | Maggio |
| 8,314,066 B2 | 11/2012 | Abribat et al. |
| 8,324,428 B2 | 12/2012 | Verdine et al. |
| 8,334,256 B2 | 12/2012 | Marsault et al. |
| 8,343,760 B2 | 1/2013 | Lu et al. |
| 8,349,887 B2 | 1/2013 | Fraser et al. |
| 8,389,484 B2 | 3/2013 | Shen et al. |
| 8,399,405 B2 | 3/2013 | Nash et al. |
| 8,435,945 B2 | 5/2013 | Abribat et al. |
| 8,450,268 B2 | 5/2013 | Fraser et al. |
| 8,524,653 B2 | 9/2013 | Nash et al. |
| 8,583,380 B2 | 11/2013 | Stephan et al. |
| 8,592,377 B2 | 11/2013 | Verdine et al. |
| 8,609,809 B2 | 12/2013 | Nash |
| 8,637,686 B2 | 1/2014 | Nash |
| 8,796,418 B2 | 8/2014 | Walensky et al. |
| 8,808,694 B2 | 8/2014 | Nash et al. |
| 8,859,723 B2* | 10/2014 | Guerlavais ............... C07K 7/56 530/317 |
| 8,871,899 B2 | 10/2014 | Wang et al. |
| 8,889,632 B2 | 11/2014 | Bernal et al. |
| 8,895,699 B2 | 11/2014 | Verdine et al. |
| 8,927,500 B2 | 1/2015 | Guerlavais et al. |
| 8,957,026 B2 | 2/2015 | Verdine et al. |
| 8,987,414 B2* | 3/2015 | Guerlavais ............... C07K 7/02 530/321 |
| 9,023,988 B2 | 5/2015 | Nash |
| 9,074,009 B2 | 7/2015 | Bradner et al. |
| 9,096,684 B2 | 8/2015 | Kawahata et al. |
| 9,163,330 B2 | 10/2015 | Verdine et al. |
| 9,175,045 B2 | 11/2015 | Nash et al. |
| 9,175,047 B2 | 11/2015 | Nash et al. |
| 9,175,056 B2 | 11/2015 | Nash |
| 9,206,223 B2 | 12/2015 | Nash et al. |
| 9,273,031 B2 | 3/2016 | Errico et al. |
| 9,273,099 B2 | 3/2016 | Walensky et al. |
| 9,371,568 B2 | 6/2016 | Gaulis et al. |
| 9,381,228 B2 | 7/2016 | Robson et al. |
| 9,394,336 B2 | 7/2016 | Nash et al. |
| 9,408,885 B2 | 8/2016 | Marine et al. |
| 9,458,189 B2 | 10/2016 | Verdine et al. |
| 9,458,202 B2 | 10/2016 | Nash et al. |
| 9,464,115 B2 | 10/2016 | Walensky et al. |
| 9,486,445 B2 | 11/2016 | Higgins et al. |
| 9,487,562 B2 | 11/2016 | Moellering et al. |
| 9,493,509 B2 | 11/2016 | Nash et al. |
| 9,505,801 B2 | 11/2016 | Verdine et al. |
| 9,505,804 B2 | 11/2016 | Guerlavais et al. |
| 9,522,947 B2 | 12/2016 | Kawahata et al. |
| 9,527,896 B2 | 12/2016 | Bernal et al. |
| 9,556,227 B2 | 1/2017 | Verdine et al. |
| 9,604,919 B2 | 3/2017 | Darlak et al. |
| 9,617,309 B2 | 4/2017 | Verdine et al. |
| 9,675,661 B2 | 6/2017 | Nash et al. |
| 9,845,287 B2 | 12/2017 | Darlak et al. |
| 2001/0047030 A1 | 11/2001 | Hay et al. |
| 2002/0002198 A1 | 1/2002 | Parr |
| 2002/0013320 A1 | 1/2002 | Busch et al. |
| 2002/0016298 A1 | 2/2002 | Hay et al. |
| 2002/0028838 A1 | 3/2002 | MacLean et al. |
| 2002/0055156 A1 | 5/2002 | Jaspers et al. |
| 2002/0061838 A1 | 5/2002 | Holmquist et al. |
| 2002/0091090 A1 | 7/2002 | Cole et al. |
| 2002/0091125 A1 | 7/2002 | Hay et al. |
| 2002/0094992 A1 | 7/2002 | MacLean |
| 2002/0098580 A1 | 7/2002 | Nandabalan et al. |
| 2002/0103221 A1 | 8/2002 | Petrie et al. |
| 2002/0128206 A1 | 9/2002 | Hay et al. |
| 2002/0132977 A1 | 9/2002 | Yuan et al. |
| 2002/0137665 A1 | 9/2002 | Evans et al. |
| 2002/0173618 A1 | 11/2002 | Rivier et al. |
| 2003/0027766 A1 | 2/2003 | Ioannides et al. |
| 2003/0060432 A1 | 3/2003 | Tocque et al. |
| 2003/0074679 A1 | 4/2003 | Schwartz et al. |
| 2003/0083241 A1 | 5/2003 | Young |
| 2003/0105114 A1 | 6/2003 | Carpino et al. |
| 2003/0144331 A1 | 7/2003 | Gudkov et al. |
| 2003/0148948 A1 | 8/2003 | Schwartz et al. |
| 2003/0157717 A1 | 8/2003 | Draghia-Akli |
| 2003/0166138 A1 | 9/2003 | Kinsella et al. |
| 2003/0176318 A1 | 9/2003 | Gudkov et al. |
| 2003/0181367 A1 | 9/2003 | O'Mahony et al. |
| 2003/0186865 A1 | 10/2003 | Acosta et al. |
| 2003/0204063 A1 | 10/2003 | Gravel et al. |
| 2004/0018967 A1 | 1/2004 | Enright et al. |
| 2004/0023887 A1 | 2/2004 | Pillutla et al. |
| 2004/0038901 A1 | 2/2004 | Basler et al. |
| 2004/0038918 A1 | 2/2004 | Draghia-Akli et al. |
| 2004/0058877 A1 | 3/2004 | Hay et al. |
| 2004/0067503 A1 | 4/2004 | Tan et al. |
| 2004/0081652 A1 | 4/2004 | Zack et al. |
| 2004/0091530 A1 | 5/2004 | Am et al. |
| 2004/0106159 A1 | 6/2004 | Kern et al. |
| 2004/0106548 A1 | 6/2004 | Schmidt et al. |
| 2004/0115135 A1 | 6/2004 | Quay |

(56) References Cited

U.S. PATENT DOCUMENTS

| | | |
|---|---|---|
| 2004/0122062 A1 | 6/2004 | MacLean et al. |
| 2004/0146971 A1 | 7/2004 | Lane et al. |
| 2004/0152708 A1 | 8/2004 | Li et al. |
| 2004/0157834 A1 | 8/2004 | Hay et al. |
| 2004/0170653 A1 | 9/2004 | Stanislawski et al. |
| 2004/0170971 A1 | 9/2004 | Kinzler et al. |
| 2004/0171530 A1 | 9/2004 | Coy et al. |
| 2004/0171809 A1 | 9/2004 | Korsmeyer et al. |
| 2004/0195413 A1 | 10/2004 | Reed et al. |
| 2004/0204358 A1 | 10/2004 | Brown et al. |
| 2004/0208866 A1 | 10/2004 | Jaspers et al. |
| 2004/0228866 A1 | 11/2004 | Lu |
| 2004/0230380 A1 | 11/2004 | Chirino et al. |
| 2004/0235746 A1 | 11/2004 | Hawiger et al. |
| 2004/0248198 A1 | 12/2004 | Kriwacki et al. |
| 2004/0248788 A1 | 12/2004 | Vickers et al. |
| 2004/0265931 A1 | 12/2004 | Gu et al. |
| 2005/0009739 A1 | 1/2005 | Wang et al. |
| 2005/0013820 A1 | 1/2005 | Holoshitz et al. |
| 2005/0014686 A1 | 1/2005 | Albert et al. |
| 2005/0031549 A1 | 2/2005 | Quay et al. |
| 2005/0037383 A1 | 2/2005 | Taremi et al. |
| 2005/0043231 A1 | 2/2005 | Cutfield et al. |
| 2005/0048618 A1 | 3/2005 | Jaspers et al. |
| 2005/0049177 A1 | 3/2005 | Bachovchin et al. |
| 2005/0054581 A1 | 3/2005 | Hay et al. |
| 2005/0059605 A1 | 3/2005 | Peri et al. |
| 2005/0065180 A1 | 3/2005 | Lee |
| 2005/0080007 A1 | 4/2005 | Ghigo et al. |
| 2005/0089511 A1 | 4/2005 | Roth et al. |
| 2005/0119167 A1 | 6/2005 | Abbenante et al. |
| 2005/0137137 A1 | 6/2005 | Lane et al. |
| 2005/0147581 A1 | 7/2005 | Zamiri et al. |
| 2005/0164298 A1 | 7/2005 | Golz et al. |
| 2005/0176075 A1 | 8/2005 | Jones et al. |
| 2005/0203009 A1 | 9/2005 | Pan et al. |
| 2005/0222224 A1 | 10/2005 | Gudkov et al. |
| 2005/0222427 A1 | 10/2005 | Sharpless et al. |
| 2005/0227932 A1 | 10/2005 | Lu et al. |
| 2005/0245438 A1 | 11/2005 | Rivier et al. |
| 2005/0245457 A1 | 11/2005 | Deghenghi |
| 2005/0245764 A1 | 11/2005 | Yamashita et al. |
| 2005/0250680 A1 | 11/2005 | Walensky et al. |
| 2005/0261201 A1 | 11/2005 | Polvino et al. |
| 2005/0277764 A1 | 12/2005 | Boyd et al. |
| 2006/0008848 A1 | 1/2006 | Verdine et al. |
| 2006/0014675 A1 | 1/2006 | Arora et al. |
| 2006/0025344 A1 | 2/2006 | Lange et al. |
| 2006/0058219 A1 | 3/2006 | Miller et al. |
| 2006/0058221 A1 | 3/2006 | Miller et al. |
| 2006/0073518 A1 | 4/2006 | Timmerman et al. |
| 2006/0100143 A1 | 5/2006 | Lu et al. |
| 2006/0111411 A1 | 5/2006 | Cooper et al. |
| 2006/0128615 A1 | 6/2006 | Gaudreau |
| 2006/0142181 A1 | 6/2006 | Miller et al. |
| 2006/0142182 A1 | 6/2006 | Miller et al. |
| 2006/0148715 A1 | 7/2006 | Tweardy |
| 2006/0149039 A1 | 7/2006 | Hunter et al. |
| 2006/0155107 A1 | 7/2006 | Rivier et al. |
| 2006/0189511 A1 | 8/2006 | Koblish et al. |
| 2006/0210641 A1 | 9/2006 | Shalaby |
| 2006/0217296 A1 | 9/2006 | Jansson |
| 2006/0233779 A1 | 10/2006 | Ben-Avraham et al. |
| 2006/0247170 A1 | 11/2006 | Guyon et al. |
| 2006/0293380 A1 | 12/2006 | Nantermet et al. |
| 2007/0004765 A1 | 1/2007 | Graffner-Nordberg et al. |
| 2007/0006332 A1 | 1/2007 | O'Neill |
| 2007/0020620 A1 | 1/2007 | Finn et al. |
| 2007/0025991 A1 | 2/2007 | Pothoulakis et al. |
| 2007/0032417 A1 | 2/2007 | Baell |
| 2007/0037857 A1 | 2/2007 | Perrissoud et al. |
| 2007/0041902 A1 | 2/2007 | Goodman et al. |
| 2007/0060512 A1 | 3/2007 | Sadeghi et al. |
| 2007/0129324 A1 | 6/2007 | Boyd et al. |
| 2007/0161544 A1 | 7/2007 | Wipf et al. |
| 2007/0161551 A1 | 7/2007 | De Luca |
| 2007/0161690 A1 | 7/2007 | Castro et al. |
| 2007/0191283 A1 | 8/2007 | Polvino |
| 2007/0197772 A1 | 8/2007 | Arora et al. |
| 2007/0208061 A2 | 9/2007 | Perrissoud et al. |
| 2007/0238662 A1 | 10/2007 | Mintz |
| 2007/0274915 A1 | 11/2007 | Rao et al. |
| 2008/0015265 A1 | 1/2008 | Rubin et al. |
| 2008/0026993 A9 | 1/2008 | Guyon et al. |
| 2008/0032931 A1 | 2/2008 | Steward et al. |
| 2008/0081038 A1 | 4/2008 | Cho et al. |
| 2008/0085279 A1 | 4/2008 | Boyd et al. |
| 2008/0090756 A1 | 4/2008 | Coy et al. |
| 2008/0132485 A1 | 6/2008 | Wang et al. |
| 2008/0161426 A1 | 7/2008 | Gudkov et al. |
| 2008/0167222 A1 | 7/2008 | Lussier et al. |
| 2008/0171700 A1 | 7/2008 | Nilsson et al. |
| 2008/0194553 A1 | 8/2008 | Gillessen et al. |
| 2008/0194672 A1 | 8/2008 | Hoveyda et al. |
| 2008/0213175 A1 | 9/2008 | Kolb et al. |
| 2008/0234183 A1 | 9/2008 | Hallbrink et al. |
| 2008/0242598 A1 | 10/2008 | Fairlie et al. |
| 2008/0250515 A1 | 10/2008 | Reed |
| 2008/0260638 A1 | 10/2008 | Rivier et al. |
| 2008/0260820 A1 | 10/2008 | Borrelly et al. |
| 2008/0261873 A1 | 10/2008 | Geesaman |
| 2008/0262200 A1 | 10/2008 | Nash |
| 2008/0299040 A1 | 12/2008 | Rivier et al. |
| 2008/0300193 A1 | 12/2008 | Ahn et al. |
| 2008/0300194 A1 | 12/2008 | Mann et al. |
| 2008/0305490 A1 | 12/2008 | Burrell et al. |
| 2008/0311608 A1 | 12/2008 | Tocque et al. |
| 2009/0011985 A1 | 1/2009 | Abribat et al. |
| 2009/0047711 A1 | 2/2009 | Nash |
| 2009/0054331 A1 | 2/2009 | Chen et al. |
| 2009/0069245 A1 | 3/2009 | Bowers et al. |
| 2009/0081168 A1 | 3/2009 | Sheppard et al. |
| 2009/0088383 A1 | 4/2009 | Abribat et al. |
| 2009/0088553 A1 | 4/2009 | Nash |
| 2009/0131478 A1 | 5/2009 | Dong et al. |
| 2009/0149630 A1 | 6/2009 | Walensky et al. |
| 2009/0156483 A1 | 6/2009 | Dong et al. |
| 2009/0156795 A1 | 6/2009 | Jaspers et al. |
| 2009/0170757 A1 | 7/2009 | Fraser et al. |
| 2009/0175821 A1 | 7/2009 | Bridon et al. |
| 2009/0176964 A1 | 7/2009 | Walensky et al. |
| 2009/0198050 A1 | 8/2009 | Marsault et al. |
| 2009/0221512 A1 | 9/2009 | Acosta et al. |
| 2009/0221689 A1 | 9/2009 | Marsault et al. |
| 2009/0240027 A1 | 9/2009 | Marsault et al. |
| 2009/0253623 A1 | 10/2009 | Abribat et al. |
| 2009/0275511 A1 | 11/2009 | Dong |
| 2009/0275519 A1 | 11/2009 | Nash et al. |
| 2009/0275648 A1 | 11/2009 | Fraser et al. |
| 2009/0305300 A1 | 12/2009 | Larsen |
| 2009/0311174 A1 | 12/2009 | Allen |
| 2009/0326192 A1 | 12/2009 | Nash et al. |
| 2009/0326193 A1 | 12/2009 | Maggio et al. |
| 2010/0010065 A1 | 1/2010 | Smith |
| 2010/0081611 A1 | 4/2010 | Bradner et al. |
| 2010/0087366 A1 | 4/2010 | Abribat et al. |
| 2010/0087381 A1 | 4/2010 | Polvino |
| 2010/0093057 A1 | 4/2010 | Beattie et al. |
| 2010/0093086 A1 | 4/2010 | Lin et al. |
| 2010/0152114 A1 | 6/2010 | Schally et al. |
| 2010/0158923 A1 | 6/2010 | Morimoto et al. |
| 2010/0168388 A1 | 7/2010 | Bernal et al. |
| 2010/0179168 A1 | 7/2010 | Blaney et al. |
| 2010/0184628 A1 | 7/2010 | Nash |
| 2010/0184645 A1 | 7/2010 | Verdine et al. |
| 2010/0204118 A1 | 8/2010 | Bevec |
| 2010/0210515 A1 | 8/2010 | Nash et al. |
| 2010/0216688 A1 | 8/2010 | Nash et al. |
| 2010/0234563 A1 | 9/2010 | Arora et al. |
| 2010/0239589 A1 | 9/2010 | Woods et al. |
| 2010/0267636 A1 | 10/2010 | Marsolais |
| 2010/0273704 A1 | 10/2010 | Korsmeyer et al. |
| 2010/0286362 A1 | 11/2010 | Boyd et al. |
| 2010/0298201 A1 | 11/2010 | Nash et al. |

(56) References Cited

U.S. PATENT DOCUMENTS

| | | |
|---|---|---|
| 2010/0298393 A1 | 11/2010 | Vanderklish et al. |
| 2010/0303791 A1 | 12/2010 | Francis et al. |
| 2010/0303794 A1 | 12/2010 | Francis et al. |
| 2010/0323964 A1 | 12/2010 | Vitali et al. |
| 2010/0331343 A1 | 12/2010 | Perrissoud et al. |
| 2011/0020435 A1 | 1/2011 | Maggio |
| 2011/0021529 A1 | 1/2011 | Lain et al. |
| 2011/0028753 A1 | 2/2011 | Verdine et al. |
| 2011/0046043 A1 | 2/2011 | Wang et al. |
| 2011/0065915 A1 | 3/2011 | Malcolmson et al. |
| 2011/0097389 A1 | 4/2011 | Sobol et al. |
| 2011/0105389 A1 | 5/2011 | Hoveyda et al. |
| 2011/0105390 A1 | 5/2011 | Lussier et al. |
| 2011/0112052 A1* | 5/2011 | Wang .................. A61K 31/407 514/81 |
| 2011/0130331 A1 | 6/2011 | Guyon et al. |
| 2011/0143992 A1 | 6/2011 | Taub et al. |
| 2011/0144303 A1 | 6/2011 | Nash et al. |
| 2011/0144306 A1 | 6/2011 | Verdine et al. |
| 2011/0151480 A1 | 6/2011 | Sheppard et al. |
| 2011/0158973 A1 | 6/2011 | Madec et al. |
| 2011/0160135 A1 | 6/2011 | Johnstone et al. |
| 2011/0165137 A1 | 7/2011 | Madec et al. |
| 2011/0166063 A1 | 7/2011 | Bossard et al. |
| 2011/0171191 A1 | 7/2011 | Johnstone et al. |
| 2011/0183917 A1 | 7/2011 | Lu et al. |
| 2011/0195080 A1 | 8/2011 | Haffer et al. |
| 2011/0218155 A1 | 9/2011 | Walensky et al. |
| 2011/0223149 A1 | 9/2011 | Nash et al. |
| 2011/0230415 A1 | 9/2011 | Berlanga et al. |
| 2011/0243845 A1 | 10/2011 | Goodman et al. |
| 2011/0245159 A1 | 10/2011 | Hoveyda et al. |
| 2011/0245175 A1 | 10/2011 | Arora et al. |
| 2011/0245459 A1 | 10/2011 | Marsault et al. |
| 2011/0245477 A1 | 10/2011 | Hoveyda et al. |
| 2011/0250685 A1 | 10/2011 | Nash |
| 2011/0251252 A1 | 10/2011 | Wang et al. |
| 2011/0263815 A1 | 10/2011 | Nash |
| 2011/0269683 A1 | 11/2011 | Rivier et al. |
| 2011/0313167 A1 | 12/2011 | Doemling |
| 2012/0004174 A1 | 1/2012 | Abribat et al. |
| 2012/0010157 A1 | 1/2012 | Polvino et al. |
| 2012/0040889 A1 | 2/2012 | Nash et al. |
| 2012/0052548 A1 | 3/2012 | Steward et al. |
| 2012/0077745 A1 | 3/2012 | Polvino |
| 2012/0082636 A1 | 4/2012 | Walensky et al. |
| 2012/0083494 A1 | 4/2012 | Aicher et al. |
| 2012/0101047 A1 | 4/2012 | Nash et al. |
| 2012/0115783 A1 | 5/2012 | Nash et al. |
| 2012/0115793 A1 | 5/2012 | Nash et al. |
| 2012/0149648 A1 | 6/2012 | Nash et al. |
| 2012/0156197 A1 | 6/2012 | Errico et al. |
| 2012/0165566 A1 | 6/2012 | Marsault et al. |
| 2012/0172311 A1 | 7/2012 | Nash et al. |
| 2012/0178700 A1 | 7/2012 | Nash et al. |
| 2012/0190818 A1 | 7/2012 | Nash |
| 2012/0226066 A1 | 9/2012 | Marsault et al. |
| 2012/0226067 A1 | 9/2012 | Marsault et al. |
| 2012/0226072 A1 | 9/2012 | Marsault et al. |
| 2012/0238507 A1 | 9/2012 | Fairlie et al. |
| 2012/0264674 A1 | 10/2012 | Nash et al. |
| 2012/0264738 A1 | 10/2012 | Sugimoto et al. |
| 2012/0270800 A1 | 10/2012 | Verdine et al. |
| 2012/0283269 A1 | 11/2012 | Blagosklonny et al. |
| 2012/0328692 A1 | 12/2012 | Lu et al. |
| 2013/0005943 A1 | 1/2013 | Arora et al. |
| 2013/0023646 A1 | 1/2013 | Nash et al. |
| 2013/0039851 A1 | 2/2013 | Maggio |
| 2013/0072439 A1 | 3/2013 | Nash et al. |
| 2013/0096050 A1 | 4/2013 | Shandler et al. |
| 2013/0123169 A1 | 5/2013 | Kawahata et al. |
| 2013/0123196 A1 | 5/2013 | Arora et al. |
| 2013/0177979 A1 | 7/2013 | Turkson |
| 2013/0210743 A1 | 8/2013 | Guerlavais et al. |
| 2013/0211046 A1 | 8/2013 | Verdine et al. |
| 2013/0274205 A1 | 10/2013 | Guerlavais et al. |
| 2013/0330421 A1 | 12/2013 | Marine et al. |
| 2013/0333419 A1 | 12/2013 | Koketsu et al. |
| 2014/0005118 A1 | 1/2014 | Verdine et al. |
| 2014/0011979 A1 | 1/2014 | Verdine et al. |
| 2014/0018302 A1 | 1/2014 | Walensky et al. |
| 2014/0051828 A1 | 2/2014 | Arora et al. |
| 2014/0128581 A1 | 5/2014 | Darlak et al. |
| 2014/0141980 A1 | 5/2014 | Stephan et al. |
| 2014/0162339 A1 | 6/2014 | Verdine et al. |
| 2014/0235549 A1 | 8/2014 | Moellering et al. |
| 2014/0256912 A1 | 9/2014 | Moellering et al. |
| 2014/0296160 A1 | 10/2014 | Walensky et al. |
| 2014/0323701 A1 | 10/2014 | Nash et al. |
| 2014/0378390 A1 | 12/2014 | Guerlavais et al. |
| 2015/0004158 A1 | 1/2015 | Shipp et al. |
| 2015/0038430 A1 | 2/2015 | Nash et al. |
| 2015/0039946 A1 | 2/2015 | Rao et al. |
| 2015/0051155 A1 | 2/2015 | Guerlavais et al. |
| 2015/0056612 A1 | 2/2015 | Shen et al. |
| 2015/0119551 A1 | 4/2015 | Bernal et al. |
| 2015/0157603 A1 | 6/2015 | Higgins et al. |
| 2015/0183825 A1 | 7/2015 | Guerlavais et al. |
| 2015/0225471 A1 | 8/2015 | Liang et al. |
| 2015/0239937 A1 | 8/2015 | Verdine et al. |
| 2015/0284437 A1 | 10/2015 | Verdine et al. |
| 2015/0285810 A1 | 10/2015 | Lu et al. |
| 2015/0376227 A1 | 12/2015 | Verdine et al. |
| 2016/0024153 A1 | 1/2016 | Verdine et al. |
| 2016/0030433 A1 | 2/2016 | Koff et al. |
| 2016/0038498 A1 | 2/2016 | Bussey et al. |
| 2016/0052970 A1 | 2/2016 | Guerlavais et al. |
| 2016/0068573 A1 | 3/2016 | Nash et al. |
| 2016/0095896 A1 | 4/2016 | Nash et al. |
| 2016/0096873 A1 | 4/2016 | Nash et al. |
| 2016/0101145 A1 | 4/2016 | Annis et al. |
| 2016/0108089 A1 | 4/2016 | Nash et al. |
| 2016/0115204 A1 | 4/2016 | Nash et al. |
| 2016/0115553 A1 | 4/2016 | Stephan et al. |
| 2016/0115554 A1 | 4/2016 | Stephan et al. |
| 2016/0115556 A1 | 4/2016 | Erlander et al. |
| 2016/0122405 A1 | 5/2016 | Palchaudhuri et al. |
| 2016/0122830 A1 | 5/2016 | Stephan et al. |
| 2016/0137710 A1 | 5/2016 | Kawahata et al. |
| 2016/0193283 A1 | 7/2016 | Chen et al. |
| 2016/0215036 A1 | 7/2016 | Verdine et al. |
| 2016/0244494 A1 | 8/2016 | Verdine et al. |
| 2016/0250278 A1 | 9/2016 | Nash et al. |
| 2016/0251399 A1 | 9/2016 | Nash et al. |
| 2016/0257716 A1 | 9/2016 | Guerlavais et al. |
| 2016/0257725 A1 | 9/2016 | Verdine et al. |
| 2016/0265065 A1 | 9/2016 | Bandla et al. |
| 2016/0287569 A1 | 10/2016 | Caenepeel et al. |
| 2016/0289274 A1 | 10/2016 | Nash |
| 2016/0289770 A1 | 10/2016 | Gaulis et al. |
| 2016/0304564 A1 | 10/2016 | Nash |
| 2016/0333049 A1 | 11/2016 | Chen et al. |
| 2016/0339023 A1 | 11/2016 | Li et al. |
| 2016/0362749 A1 | 12/2016 | Stephan et al. |
| 2017/0002042 A1 | 1/2017 | Annis et al. |
| 2017/0008930 A1 | 1/2017 | Walensky et al. |
| 2017/0015716 A1 | 1/2017 | Walensky et al. |
| 2017/0037086 A1 | 2/2017 | Kawahata et al. |
| 2017/0037105 A1 | 2/2017 | Samant |
| 2017/0066714 A1 | 3/2017 | Darlak et al. |
| 2017/0066799 A1 | 3/2017 | Verdine et al. |
| 2017/0081379 A1 | 3/2017 | Bernal et al. |
| 2017/0088581 A1 | 3/2017 | Verdine et al. |
| 2017/0107252 A1 | 4/2017 | Guerlavais et al. |
| 2017/0114098 A1 | 4/2017 | Aivado et al. |
| 2017/0212125 A1 | 7/2017 | Nash et al. |
| 2017/0226177 A1 | 8/2017 | Kawahata et al. |
| 2017/0266254 A1 | 9/2017 | Nash et al. |
| 2017/0281720 A1 | 10/2017 | Guerlavais et al. |
| 2017/0296620 A1 | 10/2017 | Nash |

(56) References Cited

U.S. PATENT DOCUMENTS

| | | | |
|---|---|---|---|
| 2017/0298099 A1 | 10/2017 | Nash et al. | |
| 2017/0360881 A1 | 12/2017 | Samant et al. | |

FOREIGN PATENT DOCUMENTS

| | | | |
|---|---|---|---|
| CA | 2761253 A1 | 6/2013 | |
| CN | 1252808 A | 5/2000 | |
| CN | 1583730 A | 2/2005 | |
| CN | 1906209 A | 1/2007 | |
| CN | 101636407 A | 1/2010 | |
| CN | 102223891 A | 10/2011 | |
| CN | 102399283 A | 4/2012 | |
| CN | 102399284 A | 4/2012 | |
| CZ | 9700369 A3 | 9/1998 | |
| EP | 0467699 A2 | 1/1992 | |
| EP | 0467699 A3 | 2/1993 | |
| EP | 0528312 A2 | 2/1993 | |
| EP | 0552417 A1 | 7/1993 | |
| EP | 0352014 B1 | 3/1994 | |
| EP | 0729972 A1 | 9/1996 | |
| EP | 0643726 B1 | 8/1999 | |
| EP | 0977580 B1 | 4/2003 | |
| EP | 1321474 A1 | 6/2003 | |
| EP | 1452868 A2 | 9/2004 | |
| EP | 1541692 A1 | 6/2005 | |
| EP | 1602663 A1 | 12/2005 | |
| EP | 1609802 A1 | 12/2005 | |
| EP | 1243923 B1 | 3/2006 | |
| EP | 1180016 B1 | 9/2006 | |
| EP | 0958305 B1 | 6/2008 | |
| EP | 2091552 A2 | 8/2009 | |
| EP | 2100901 A1 | 9/2009 | |
| EP | 2310407 A2 | 4/2011 | |
| EP | 1597585 B1 | 6/2011 | |
| EP | 2377849 A2 | 10/2011 | |
| EP | 2488193 A1 | 8/2012 | |
| EP | 2489360 A1 | 8/2012 | |
| EP | 2114428 B1 | 10/2012 | |
| EP | 2637680 A2 | 9/2013 | |
| EP | 3027212 A1 | 6/2016 | |
| EP | 2474624 B1 | 8/2016 | |
| EP | 3059322 A1 | 8/2016 | |
| EP | 2474625 B1 | 11/2016 | |
| EP | 2245464 B1 | 12/2016 | |
| JP | 2002524391 A | 8/2002 | |
| JP | 2008501623 A | 1/2008 | |
| JP | 2008096423 A | 4/2008 | |
| JP | 2010510236 A | 4/2010 | |
| JP | 2010518017 A | 5/2010 | |
| JP | 2010120881 A | 6/2010 | |
| JP | 2010519318 A | 6/2010 | |
| JP | 2012503025 A | 2/2012 | |
| WO | WO-8909233 A1 | 10/1989 | |
| WO | WO-8912675 A1 | 12/1989 | |
| WO | WO-9206998 A1 | 4/1992 | |
| WO | WO-9213878 A2 | 8/1992 | |
| WO | WO-9301203 A1 | 1/1993 | |
| WO | WO-9307170 A1 | 4/1993 | |
| WO | WO-9422910 A1 | 10/1994 | |
| WO | WO-9425482 A1 | 11/1994 | |
| WO | WO-9500534 A1 | 1/1995 | |
| WO | WO-9522546 A1 | 8/1995 | |
| WO | WO-9602642 A1 | 2/1996 | |
| WO | WO-9620951 A1 | 7/1996 | |
| WO | WO-9628449 A1 | 9/1996 | |
| WO | WO-9632126 A1 | 10/1996 | |
| WO | WO-9634878 A1 | 11/1996 | |
| WO | WO-9700267 A1 | 1/1997 | |
| WO | WO-9713537 A1 | 4/1997 | |
| WO | WO-9714794 A1 | 4/1997 | |
| WO | WO-9726002 A1 | 7/1997 | |
| WO | WO-9730072 A1 | 8/1997 | |
| WO | WO-9737705 A1 | 10/1997 | |
| WO | WO-9801467 A2 | 1/1998 | |
| WO | WO-9817625 A1 | 4/1998 | |
| WO | WO-9846631 A1 | 10/1998 | |
| WO | WO-9847525 A1 | 10/1998 | |
| WO | WO-9914259 A1 | 3/1999 | |
| WO | WO-9934833 A1 | 7/1999 | |
| WO | WO-9934850 A1 | 7/1999 | |
| WO | WO-9963929 A2 | 12/1999 | |
| WO | WO-0006187 A2 | 2/2000 | |
| WO | WO-0006187 A3 | 5/2000 | |
| WO | WO-02064790 A2 | 8/2002 | |
| WO | WO-02070547 A1 | 9/2002 | |
| WO | WO-02072597 A2 | 9/2002 | |
| WO | WO-02064790 A3 | 5/2003 | |
| WO | WO-03054000 A1 | 7/2003 | |
| WO | WO-03059933 A2 | 7/2003 | |
| WO | WO-03070892 A2 | 8/2003 | |
| WO | WO-03102538 A2 | 12/2003 | |
| WO | WO 03106491 A2 | 12/2003 | |
| WO | WO-03059933 A3 | 1/2004 | |
| WO | WO-2004026896 A2 | 4/2004 | |
| WO | WO-2004037754 A2 | 5/2004 | |
| WO | WO-2004041275 A1 | 5/2004 | |
| WO | WO-2004058804 A1 | 7/2004 | |
| WO | WO-2004077062 A2 | 9/2004 | |
| WO | WO-2004037754 A3 | 10/2004 | |
| WO | WO-03070892 A3 | 11/2004 | |
| WO | WO-03106491 A3 | 12/2004 | |
| WO | WO-2004077062 A3 | 1/2005 | |
| WO | WO-2005001023 A2 | 1/2005 | |
| WO | WO-2005007675 A2 | 1/2005 | |
| WO | WO-2004077062 B1 | 2/2005 | |
| WO | WO-2005012335 A1 | 2/2005 | |
| WO | WO-2005035568 A1 | 4/2005 | |
| WO | WO-2005040202 A2 | 5/2005 | |
| WO | WO-2005044839 A2 | 5/2005 | |
| WO | WO-2005040202 A3 | 6/2005 | |
| WO | WO-2005007675 A3 | 7/2005 | |
| WO | WO-2005044839 A3 | 7/2005 | |
| WO | WO-2005074521 A2 | 8/2005 | |
| WO | WO-2005085457 A2 | 9/2005 | |
| WO | WO-2005090388 A1 | 9/2005 | |
| WO | WO-2005097173 A2 | 10/2005 | |
| WO | WO-2005118620 A2 | 12/2005 | |
| WO | WO-2005118625 A1 | 12/2005 | |
| WO | WO-2005118634 A2 | 12/2005 | |
| WO | WO-2006009645 A1 | 1/2006 | |
| WO | WO-2006009674 A1 | 1/2006 | |
| WO | WO-2006042408 A1 | 4/2006 | |
| WO | WO-2005118634 A3 | 5/2006 | |
| WO | WO-2005118620 A3 | 6/2006 | |
| WO | WO-2006078161 A1 | 7/2006 | |
| WO | WO-2006103666 A2 | 10/2006 | |
| WO | WO-2006137974 A2 | 12/2006 | |
| WO | WO-2006103666 A3 | 3/2007 | |
| WO | WO-2007141533 A2 | 12/2007 | |
| WO | WO-2008013454 A2 | 1/2008 | |
| WO | WO-2008014216 A1 | 1/2008 | |
| WO | WO-2008040000 A2 | 4/2008 | |
| WO | WO-2008045238 A2 | 4/2008 | |
| WO | WO-2008061192 A2 | 5/2008 | |
| WO | WO-2008074895 A1 | 6/2008 | |
| WO | WO-2008076904 A1 | 6/2008 | |
| WO | WO-2007141533 A3 | 7/2008 | |
| WO | WO-2008061192 A3 | 7/2008 | |
| WO | WO-2008092281 A1 | 8/2008 | |
| WO | WO-2008095063 A1 | 8/2008 | |
| WO | WO-2008104000 A2 | 8/2008 | |
| WO | WO-2008106507 A1 | 9/2008 | |
| WO | WO-2008121767 A2 | 10/2008 | |
| WO | WO-2008130464 A1 | 10/2008 | |
| WO | WO-2008104000 A3 | 11/2008 | |
| WO | WO-2008137633 A2 | 11/2008 | |
| WO | WO-2008121767 A3 | 1/2009 | |
| WO | WO-2009009727 A2 | 1/2009 | |
| WO | WO-2009031916 A1 | 3/2009 | |
| WO | WO-2009033667 A2 | 3/2009 | |
| WO | WO-2009033668 A2 | 3/2009 | |
| WO | WO-2009042237 A2 | 4/2009 | |
| WO | WO-2009009727 A3 | 5/2009 | |
| WO | WO-2009089004 A1 | 7/2009 | |

(56) References Cited

FOREIGN PATENT DOCUMENTS

| | | |
|---|---|---|
| WO | WO-2009033667 A3 | 8/2009 |
| WO | WO-2009033668 A3 | 8/2009 |
| WO | WO-2009099677 A2 | 8/2009 |
| WO | WO-2009110952 A2 | 9/2009 |
| WO | WO-2009126292 A2 | 10/2009 |
| WO | WO-2009129311 A2 | 10/2009 |
| WO | WO-2009137532 A1 | 11/2009 |
| WO | WO-2009042237 A3 | 12/2009 |
| WO | WO-2009149214 A2 | 12/2009 |
| WO | WO-2009149339 A2 | 12/2009 |
| WO | WO-2010011313 A2 | 1/2010 |
| WO | WO-2010013011 A1 | 2/2010 |
| WO | WO-2010033617 A2 | 3/2010 |
| WO | WO-2010033879 A2 | 3/2010 |
| WO | WO-2010034026 A1 | 3/2010 |
| WO | WO-2010034028 A1 | 3/2010 |
| WO | WO-2010034029 A1 | 3/2010 |
| WO | WO-2010034031 A1 | 3/2010 |
| WO | WO-2010034032 A2 | 3/2010 |
| WO | WO-2010034034 A1 | 3/2010 |
| WO | WO-2010058819 A1 | 5/2010 |
| WO | WO-2010060112 A1 | 5/2010 |
| WO | WO-2010065572 A1 | 6/2010 |
| WO | WO-2010068684 A2 | 6/2010 |
| WO | WO-2009129311 A3 | 7/2010 |
| WO | WO-2010083347 A2 | 7/2010 |
| WO | WO-2010083501 A2 | 7/2010 |
| WO | WO-2010100351 A1 | 9/2010 |
| WO | WO-2010107485 A1 | 9/2010 |
| WO | WO-2010121288 A1 | 10/2010 |
| WO | WO-2010132580 A2 | 11/2010 |
| WO | WO-2010011313 A3 | 12/2010 |
| WO | WO-2011005219 A1 | 1/2011 |
| WO | WO-2011008260 A2 | 1/2011 |
| WO | WO-2011008260 A3 | 3/2011 |
| WO | WO-2011023677 A1 | 3/2011 |
| WO | WO-2011038049 A1 | 3/2011 |
| WO | WO-2011047215 A1 | 4/2011 |
| WO | WO-2011060049 A2 | 5/2011 |
| WO | WO-2011061139 A1 | 5/2011 |
| WO | WO-2011076786 A1 | 6/2011 |
| WO | WO-2011090297 A2 | 7/2011 |
| WO | WO-2011101297 A1 | 8/2011 |
| WO | WO-2011106650 A2 | 9/2011 |
| WO | WO-2011133948 A2 | 10/2011 |
| WO | WO-2011143208 A1 | 11/2011 |
| WO | WO-2011143209 A1 | 11/2011 |
| WO | WO-2011153491 A2 | 12/2011 |
| WO | WO-2011159917 A2 | 12/2011 |
| WO | WO-2011161699 A2 | 12/2011 |
| WO | WO-2011162968 A1 | 12/2011 |
| WO | WO-2011163012 A2 | 12/2011 |
| WO | WO-2011133948 A3 | 1/2012 |
| WO | WO-2012012352 A2 | 1/2012 |
| WO | WO-2012016186 A1 | 2/2012 |
| WO | WO-2012021874 A1 | 2/2012 |
| WO | WO-2012021875 A1 | 2/2012 |
| WO | WO-2012021876 A2 | 2/2012 |
| WO | WO-2012023525 A2 | 3/2012 |
| WO | WO-2012034954 A1 | 3/2012 |
| WO | WO-2012037519 A2 | 3/2012 |
| WO | WO-2012038307 A1 | 3/2012 |
| WO | WO-2012040459 A2 | 3/2012 |
| WO | WO-2011153491 A3 | 4/2012 |
| WO | WO-2012045018 A1 | 4/2012 |
| WO | WO-2012047587 A2 | 4/2012 |
| WO | WO-2012051405 A1 | 4/2012 |
| WO | WO-2012059696 A1 | 5/2012 |
| WO | WO-2012065022 A2 | 5/2012 |
| WO | WO-2012065181 A2 | 5/2012 |
| WO | WO-2012066095 A1 | 5/2012 |
| WO | WO-2012040459 A3 | 6/2012 |
| WO | WO-2012076513 A1 | 6/2012 |
| WO | WO-2012080376 A1 | 6/2012 |
| WO | WO-2012080389 A1 | 6/2012 |
| WO | WO-2012083078 A2 | 6/2012 |
| WO | WO-2012083181 A1 | 6/2012 |
| WO | WO-2011159917 A3 | 7/2012 |
| WO | WO-2012094755 A1 | 7/2012 |
| WO | WO-2012037519 A3 | 8/2012 |
| WO | WO-2012121057 A1 | 9/2012 |
| WO | WO-2012122059 A1 | 9/2012 |
| WO | WO-2012149563 A1 | 11/2012 |
| WO | WO-2012173846 A2 | 12/2012 |
| WO | WO-2012174423 A1 | 12/2012 |
| WO | WO-2012175962 A1 | 12/2012 |
| WO | WO-2013033645 A1 | 3/2013 |
| WO | WO-2013036208 A1 | 3/2013 |
| WO | WO-2013049250 A1 | 4/2013 |
| WO | WO-2013059525 A1 | 4/2013 |
| WO | WO-2013059530 A2 | 4/2013 |
| WO | WO-2013062923 A1 | 5/2013 |
| WO | WO-2013116829 A1 | 8/2013 |
| WO | WO2013123266 A1 * | 8/2013 | ............ A61K 38/12 |
| WO | WO-2013123266 A1 | 8/2013 |
| WO | WO-2013123267 A1 | 8/2013 |
| WO | WO-2013166319 A1 | 11/2013 |
| WO | WO-2014020502 A2 | 2/2014 |
| WO | WO-2014047673 A1 | 4/2014 |
| WO | WO-2014052647 A2 | 4/2014 |
| WO | WO-2014055564 A1 | 4/2014 |
| WO | WO-2014071241 A1 | 5/2014 |
| WO | WO-2014115080 A1 | 7/2014 |
| WO | WO-2014134201 A1 | 9/2014 |
| WO | WO-2014138429 A2 | 9/2014 |
| WO | WO-2014144121 A2 | 9/2014 |
| WO | WO-2015000945 A1 | 1/2015 |
| WO | WO-2015017803 A1 | 2/2015 |
| WO | WO-2015097622 A1 | 7/2015 |
| WO | WO-2015108175 A1 | 7/2015 |
| WO | WO-2015097621 A3 | 10/2015 |
| WO | WO-2015157508 A1 | 10/2015 |
| WO | WO-2015179799 A1 | 11/2015 |
| WO | WO-2015198266 A1 | 12/2015 |
| WO | WO-2016040892 A1 | 3/2016 |
| WO | WO-2016049355 A1 | 3/2016 |
| WO | WO-2016049359 A1 | 3/2016 |
| WO | WO-2016055497 A1 | 4/2016 |
| WO | WO-2016056673 A1 | 4/2016 |
| WO | WO-2016073184 A1 | 5/2016 |
| WO | WO-2016105503 A1 | 6/2016 |
| WO | WO-2016154058 A1 | 9/2016 |
| WO | WO-2017004548 A1 | 1/2017 |
| WO | WO-2017004591 A2 | 1/2017 |
| WO | WO-2017023933 A2 | 2/2017 |
| WO | WO-2017040990 A1 | 3/2017 |
| WO | WO-2017044633 A1 | 3/2017 |
| WO | WO-2017165299 A2 | 9/2017 |
| WO | WO-2017205786 A1 | 11/2017 |
| WO | WO-2017218949 A2 | 12/2017 |

OTHER PUBLICATIONS

Checco, et al. α/β-Peptide foldamers targeting intracellular protein-protein interactions with activity in living cells. Journal of the American Chemical Society 137.35 (2015): 11365-11375.

Chou, et al., "Quantitative analysis of dose-effect relationships: The combined effects of multiple drugs or enzyme inhibitors," Lab of Pharma, John Hopkins 22: 27-55 (1984).

European search report and opinion dated Feb. 9, 2012 for EP Application No. 09815315.8.

Hermeking, "p53 enters the microRNA world," Cancer Cell, 12(5):414-418, 2007.

Hermeking. MicroRNAs in the p53 network: micromanagement of tumour suppression. Nat Rev Cancer. Sep. 2012;12(9):613-26. doi: 10.1038/nrc3318. Epub Aug. 17, 2012.

International search report and written opinion dated Feb. 7, 2013 for PCT Application No. US12/60913.

International search report and written opinion dated May 18, 2010 for PCT Application No. US2009/057592.

International search report and written opinion dated Oct. 3, 2014 for PCT Application No. US2014/021292.

(56) References Cited

OTHER PUBLICATIONS

International search report and written opinion dated Dec. 1, 2015 for PCT Application No. US2015/049458.
International search report and written opinion dated Dec. 19, 2016 for PCT Application No. PCT/US2016/050789.
International search report dated Oct. 22, 2009 for PCT Application No. US2009/00837.
International search report with written opinion dated Feb. 16, 2017 for PCT/US2016/045165.
Jenkins, D.E., et al. In Vivo Monitoring of Tumor Relapse and Metastasis using Bioluminescent PC-3M-luc-C6 cells in Murine Models of Human Prostate Cancer. Clin. Exp. Metastasis. 2003;20(8):745-56.
Jenkins, et al. Bioluminescent imaging (BLI) to improve and refine traditional murine models of tumor growth and metastasis. Clin Exp Metastasis. 2003; 20(8): 733-44.
Le, et al. PD-1 Blockade in Tumors with Mismatch-Repair Deficiency. N Engl J Med. Jun. 25, 2015;372(26):2509-20. doi: 10.1056/NEJMoa1500596. Epub May 30, 2015.
Lelekakis, M., et al. A novel orthotopic model of breast cancer metastasis to bone. Clin. Exp. Metastasis.Mar. 1999;17(2):163-70.
Li, et al. A convenient preparation of 5-iodo-1,4-disubstituted-1,2,3-triazole: multicomponent one-pot reaction of azide and alkyne mediated by CuI-NBS. J Org Chem. May 2, 2008;73(9):3630-3. doi: 10.1021/jo800035v. Epub Mar. 22, 2008.
Notice of allowance dated May 12, 2016 for U.S. Appl. No. 14/750,649.
Notice of allowance dated Aug. 31, 2016 for U.S. Appl. No. 14/750,649.
Notice of allowance dated Mar. 30, 2015 for U.S. Appl. No. 13/655,378.
Notice of allowance dated May 13, 2014 for U.S. Appl. No. 13/352,223.
Notice of allowance dated Nov. 17, 2016 for U.S. Appl. No. 14/070,306.
Notice of allowance dated Dec. 12, 2017 for U.S. Appl. No. 15/287,513.
Office action dated Jan. 12, 2017 for U.S. Appl. No. 15/278,824.
Office action dated Jan. 17, 2018 for U.S. Appl. No. 14/608,641.
Office Action dated Mar. 28, 2016 for U.S. Appl. No. 14/070,306.
Office Action dated Jun. 4, 2015 for U.S. Appl. No. 14/070,306.
Office action dated Jun. 19, 2017 for U.S. Appl. No. 15/135,098.
Office action dated Jun. 26, 2012 for U.S. Appl. No. 12/378,047.
Office action dated Jul. 7, 2017 for U.S. Appl. No. 14/864,801.
Office action dated Aug. 14, 2012 for U.S. Appl. No. 13/352,223.
Office action dated Aug. 22, 2011 for U.S. Appl. No. 12/378,047.
Office action dated Aug. 30, 2017 for U.S. Appl. No. 15/287,513.
Office action dated Sep. 5, 2017 for U.S. Appl. No. 15/093,869.
Office action dated Sep. 7, 2017 for U.S. Appl. No. 15/093,426.
Office action dated Sep. 16, 2016 for U.S. Appl. No. 14/325,933.
Office action dated Oct. 26, 2017 for U.S. Appl. No. 14/460,848.
Office action dated Nov. 15, 2017 for U.S. Appl. No. 15/240,505.
Office action dated Nov. 24, 2017 for U.S. Appl. No. 15/135,098.
Office action dated Nov. 26, 2013 for U.S. Appl. No. 13/655,378.
Office action dated Dec. 19, 2012 for U.S. Appl. No. 13/352,223.
Overview of Leukemia. Merck Manuals. Aug. 20, 2014. merckmanuals.com/home/blood_disorders!leukemias/overview_of_leukemia.html?qt=Leukemia&alt=sh. 2 pages.
Palani, et al. Histone deacetylase inhibitors enhance the anticancer activity of nutlin-3 and induce p53 hyperacetylation and downregulation of MDM2 and MDM4 gene expression. Invest New Drugs. Feb. 2012;30(1):25-36. doi: 10.1007/s10637-010-9510-7. Epub Aug. 3, 2010.
PCT/US2016/023275 International Preliminary Report on Patentability dated Oct. 5, 2017.
Scatena, C.D., et al. Imaging of bioluminescent LNCaP-luc-M6 tumors: a new animal model for the study of metastatic human prostate cancer. Prostate. May 15, 2004:59(3):292-303.

Schafmeister, et al. An all-hydrocarbon cross-linking system for enhancing the helicity and metabolic stability of peptides. Journal of the American Chemical Society. 2000;122(24):5891-5892.
Toffoli, et al. Intermittent hypoxia is a key regulator of cancer cell and endothelial cell interplay in tumours. FEBS J. Jun. 2008;275(12):2991-3002. doi: 10.1111/j.1742-4658.2008.06454.x. Epub Apr. 25, 2008.
U.S. Appl. No. 15/093,426 Notice of Allowance dated Feb. 27, 2018.
U.S. Appl. No. 15/093,426 Office action dated Jan. 8, 2018.
U.S. Appl. No. 15/093,869 Office action dated Jan. 22, 2018.
U.S. Appl. No. 15/135,098 Notice of Allowance dated Jan. 25, 2018.
Zhang, et al. Chemopreventive agents induce programmed death-1-ligand 1 (PD-L1) surface expression in breast cancer cells and promote PD-L1-mediated T cell apoptosis. Mol Immunol. Mar. 2008;45(5):1470-6. Epub Oct. 24, 2007.
Zhang, et al. Synergistic combination of microtubule targeting anticancer fludelone with cytoprotective panaxytriol derived from panax ginseng against MX-1 cells in vitro: experimental design and data analysis using the combination index method. Am J Cancer Res. Dec. 15, 2015;6(1):97-104. eCollection 2016.
Abbas, et al. (2010). Mdm2 is required for survival of hematopoietic stem cells/progenitors via dampening of ROS-induced p53 activity. Cell Stem Cell 7, 606-617.
Abraham, et al. (2016). Dual targeting of p53 and c-MYC selectively eliminates leukaemic stem cells. Nature 534, 341-346.
Adhikary et al., Transcriptional regulation and transformation by Myc proteins. Nat Rev Mol Cell Biol. Aug. 2005;6(8):635-45.
Agola et al., Rab GTPases as regulators of endocytosis, targets of disease and therapeutic opportunities. Clin Genet. Oct. 2011; 80(4): 305-318.
Ahn, et al. A convenient method for the efficient removal of ruthenium byproducts generated during olefin metathesis reactions. Organic Letters. 2001; 3(9):1411-1413.
Akala, et al. (2008). Long-term haematopoietic reconstitution by Trp53-/-p16Ink4a-/-p19Arf-/-multipotent progenitors. Nature 453, 228-232.
Al-Lazikani, et al. Combinatorial drug therapy for cancer in the post-genomic era. Nature biotechnology 30.7 (2012): 679-692.
Altschul et al. Basic local alignment search tool. J Mol Biol215(3):403-410 (1990).
Aman et al., cDNA cloning and characterization of the human interleukin 13 receptor alpha chain. J Biol Chem. Nov. 15, 1996;271(46):29265-70.
Andreeff, et al. (2016). Results of the Phase I Trial of RG7112, a Small-Molecule MDM2 Antagonist in Leukemia. Clin Cancer Res 22, 868-876.
Andrews et al. Forming Stable Helical Peptide Using Natural and Artificial Amino Acids. Tetrahedron. 1999;55:11711-11743.
Andrews et al., Kinetic analysis of the interleukin-13 receptor complex. J Biol Chem. Nov. 29, 2002;277(48):46073-8. Epub Sep. 26, 2002.
Angel & Karin, "The Role of Jun, Fos and the AP-1 Complex in Cell-proliferation and Transformation," Biochim. Biophys. Acta 1072:129-157 (1991).
Angell, et al. Peptidomimetics via copper-catalyzed azide-alkyne cycloadditions. Chem Soc Rev. Oct. 2007;36(10):1674-89.
Angell, et al. Ring closure to beta-turn mimics via copper-catalyzed azide/alkyne cycloadditions. J Org Chem. Nov. 11, 2005;70(23):9595-8.
Annis, et al. A general technique to rank protein-ligand binding affinities and determine allosteric versus direct binding site competition in compound mixtures. J Am Chem Soc. Dec. 1, 2004;126(47):15495-503.
Annis, et al. ALIS: An Affinity Selection-Mass Spectrometry System for the Discovery and Characterization of Protein-Ligand Interactions. In: Wanner, K. and Höfner, G. eds. Mass Spectrometry in Medicinal Chemistry. Wiley-VCH; 2007:121-156.
Annis, et al. ALIS: An affinity selection-mass spectrometry system for the discovery and characterization of protein-ligand Interactions. Mass Spectrometry in Medicinal Chemistry: Applications in Drug Discovery (2007): 121-156.

(56) References Cited

OTHER PUBLICATIONS

Armstrong et al., X=Y–ZH Systems as potential 1,3-dipoles. 5. Intramolecular cycloadditions of imines of a-amino acid esters. Tetrahedron. 1985;41(17):3547-58.
Arora, "Design, Synthesis, and Properties of the Hydrogen Bond Surrogate-based Artificial Alpha-helices," American Chemical Society Meeting, San Diego (Mar. 2005) (oral).
Arora, "Hydrogen Bond Surrogate Approach for the Synthesis of Short α-Helical Peptides," American Chemical Society Meeting, Philadelphia (Aug. 2004) (abstract of oral presentation).
Arosio, et al. Click chemistry to functionalise peptidomimetics. Tetrahedron Letters. 2006; 47:3697-3700.
Artavanis-Tsakonas et al., Notch signaling: cell fate control and signal integration in development. Science. Apr. 30, 1999;284(5415):770-6.
Asai, et al. (2012). Necdin, a p53 target gene, regulates the quiescence and response to genotoxic stress of hematopoietic stem/progenitor cells. Blood 120, 1601-1612.
Attisano et al., TGFbeta and Wnt pathway cross-talk. Cancer Metastasis Rev. Jan.-Jun. 2004;23(1-2):53-61.
Austin et al., "A Template for Stabilization of a Peptide α-Helix: Synthesis and Evaluation of Conformational Effects by Circular Dichroism and NMR," J. Am. Chem. Soc. 119:6461-6472 (1997).
Babcock, Proteins, radicals, isotopes, and mutants in photosynthetic oxygen evolution. Proc Natl Acad Sci U S A. Dec. 1, 1993;90(23):10893-5.
Babine et aL, Molecular Recognition of Proteinminus signLigand Complexes: Applications to Drug Design. Chem Rev. Aug. 5, 1997;97(5):1359-1472.
Badyal, et al. A Simple Method for the Quantitative Analysis of Resin Bound Thiol Groups. Tetrahedron Lett. 2001; 42:8531-33.
Baek, et al. Structure of the stapled p53 peptide bound to Mdm2. J Am Chem Soc. Jan. 11, 2012;134(1):103-6. doi: 10.1021/ja2090367. Epub Dec. 14, 2011.
Baell, J.B. Prospects for Targeting the Bcl-2 Family of Proteins to Develop Novel cytotoxic drugs. Biochem Pharmacol. Sep. 2002;64(5-6):851-63.
Bakhshi, et al. Cloning the chromosomal breakpoint of t(14;18) human lymphomas: clustering around JH on chromosome 14 and near a transcriptional unit on 18. Cell. Jul. 1985;41(3):899-906.
Balof, et al. Olefin metathesis catalysts bearing a pH-responsive NHC ligand: a feasible approach to catalyst separation from RCM products. Dalton Trans. Nov. 14, 2008;(42):5791-9. doi: 10.1039/b809793c. Epub Sep. 12, 2008.
Balthaser et al., Remodelling of the natural product fumagillol employing a reaction discovery approach. Nat Chem. Dec. 2011;3(12):969-73.
Banerjee et aL, Structure of a DNA glycosylase searching for lesions. Science. Feb. 24, 2006;311(5764):1153-7.
Banerjee et al., Structure of a repair enzyme interrogating undamaged DNA elucidates recognition of damaged DNA. Nature. Mar. 31, 2005;434(7033):612-8.
Banerji et al. Synthesis of Cyclic β-Turn Mimics from L-Pro-Phe/Phe-L-Pro Derived Di- and Tripeptides via Ring Closing Metathesis: The Role of Chirality of the Phe Residue During Cyclization. Tetrahedron Lett. 2002; 43:6473-6477.
Bang et al., Total chemical synthesis of crambin. J Am Chem Soc. Feb. 11, 2004;126(5):1377-83.
Bansal, et al. Salt selection in drug development. Pharmaceutical Technology. Mar. 2, 2008;3(32).
Barandon et al., Reduction of infarct size and prevention of cardiac rupture in transgenic mice overexpressing FrzA. Circulation. Nov. 4, 2003;108(18):2282-9. Epub Oct. 27, 2003.
Barker, et al. Cyclic RGD peptide analogues as antiplatelet antithrombotics. J Med Chem. May 29, 1992;35(11):2040-8. (Abstract only).
Barker et al., Mining the Wnt pathway for cancer therapeutics. Nat Rev Drug Discov. Dec. 2006;5(12):997-1014.
Barreyro, et al. (2012). Overexpression of IL-1 receptor accessory protein in stem and progenitor cells and outcome correlation in AML and MDS. Blood 120, 1290-1298.
Belokon et al., Chiral Complexes of Ni(II), Cu(II) and Cu(I) as Reagents, Catalysts and Receptors for Asymmetric Synthesis and Chiral Recognition of Amino Acids. Pure & Appl Chem. 1992;64(12):1917-24.
Belokon et al., Improved procedures for the synthesis of (S)-21N-(N'-benzyl-prolypaminolbenzophenone (BPB) and Ni(II) complexes of Schiff's bases derived from BPB and amino acids. Tetrahedron: Asymmetry. 1998;9:4249-52.
Belokon, et al. Improved procedures for the synthesis of (S)-2-[N-(N'-benzylprolyl)amino]benzophenone (BPB) and Ni(II) complexes of Schiff's bases derived from BPB and amino acids. Tetrahedron: Asymmetry, vol. 9, Issue 23, Dec. 11, 1998, pp. 4249-4252.
Belokon, Y. N., et al., "Halo-substituted (S)-N-(2-benzoylphenyl)-1-benzylpyrolidine-2 carboxamides as new chiral auxiliaries for the asymmetric synthesis of (S)-a-amino acids," Russian Chemical Bulletin, International Edition, 51 (8): 1593-1599 (2002).
Bennett, et al. Regulation of osteoblastogenesis and bone mass by Wntl Ob. Proc Natl Acad Sci U S A. Mar. 1, 2005;102(9):3324-9 . . . Epub Feb. 22, 2005.
Berendsen et al. A glimpse of the Holy Grail? Science 282(5389):642-643 (1998).
Berezowska; et al., "Cyclic dermorphin tetrapeptide analogues obtained via ring-closing metathesis. Acta Biochim Pol. 2006;53(1):73-6. Epub Feb. 23, 2006."
Berge et al. Pharmaceutical Salts. Journal of Pharmaceutical Sciences 66(1):1-19 (Jan. 1977).
Bernal, et al. (2010). A stapled p53 helix overcomes HDMX-mediated suppression of p53. Cancer Cell 18, 411-422.
Bernal, et al. A stapled p53 helix overcomes HDMX-mediated suppression of p53. Cancer Cell. Nov. 16, 2010;18(5):411-22. doi: 10.1016/j.ccr.2010.10.024.
Bernal et al., Reactivation of the p53 tumor suppressor pathway by a stapled p53 peptide. (2007) J. Am Chem Soc. 9129, 2456-2457.
Bernal, et al. Reactivation of the p53 tumor suppressor pathway by a stapled p53 peptide. J Am Chem Soc. Mar. 7, 2007;129(9):2456-7.
Bertrand, et al. (1998). Localization of ASH1 mRNA particles in living yeast. Mol Cell 2, 437-445.
Biagini et al., Cross-metathesis of Unsaturated a-amino Acid Derivatives. J Chem Soc Perkin Trans. 1998;1:2485-99.
Bierzynski et al. A salt bridge stabilizes the helix formed by isolated C-Peptide of RNase A. PNAS USA. 1982;79:2470-2474.
Blackwell, et al. Highly Efficient Synthesis of Covalently Cross-Linked Peptide Helices by Ring-Closing Metathesis. Angewandte Chemie International Edition. 1998; 37(23):3281-3284.
Blackwell, et al. Ring-closing metathesis of olefinic peptides: design, synthesis, and structural characterization of macrocyclic helical peptides. J Org Chem. Aug. 10, 2001;66(16):5291-302.
Blangetti et al., Suzuki-miyaura cross-coupling in acylation reactions, scope and recent developments.Molecules. Jan. 17, 2013;18(1):1188-213. doi:10.3390/molecules18011188.
Blundell et al., Atomic positions in rhombohedral 2-zinc insulin crystals. Nature. Jun. 25, 1971;231(5304):506-11.
Bo, M.D., et al. (2010). MDM4 (MDMX) is overexpressed in chronic lymphocytic leukaemia (CLL) and marks a subset of p53wild-type CLL with a poor cytotoxic response to Nutlin-3. Br J Haematol 150, 237-239.
Bock, et al. 1,2,3-Triazoles as peptide bond isosteres: synthesis and biological evaluation of cyclotetrapeptide mimics. Org Biomol Chem. Mar. 21, 2007;5(6):971-5.
Bode et al., Chemoselective amide ligations by decarboxylative condensations of N-alkylhydroxylamines and alpha-ketoacids. Angew Chem Int Ed Engl. Feb. 13, 2006;45(8):1248-52.
Boguslavsky, et al. Effect of peptide conformation on membrane permeability. J Pept Res. Jun. 2003;61(6):287-97.
Bossy-Wetzel et al. Assays for cytochrome c release from mitochondria during apoptosis. Methods Enzymol. 322:235-242 (2000).
Bossy-Wetzel, et al. Detection of apoptosis by annexin V labeling. Methods Enzymol. 2000;322:15-8.
Bottger, et al. Molecular characterization of the hdm2-p53 interaction. J Mol Biol. Jun. 27, 1997;269(5):744-56.
Boyden et al. High bone density due to a mutation in LDL-receptor-related protein 5. N Engl J Med 346(20):1513-1521 (2002).

(56) References Cited

OTHER PUBLICATIONS

Bracken et al. Synthesis and nuclear magnetic resonance structure determination of an alpha-helical, bicyclic, lactam-bridged hexapeptide. JACS. 1994;116:6431-6432.
Bradley et al. Limits of cooperativity in a structurally modular protein: response of the Notch ankyrin domain to analogous alanine substitutions in each repeat. J Mol Biol. 324(2):373-386 (2002).
Brandt et al., Dimeric fragment of the insulin receptor alpha-subunit binds insulin with full holoreceptor affinity. J Biol Chem. Apr. 13, 2001;276(15):12378-84. Epub Jan. 12, 2001.
Bray, Notch signalling: a simple pathway becomes complex. Nat Rev Mol Cell Biol. Sep. 2006;7(9):678-89.
Brea, et al. Synthesis of omega-(hetero)arylalkynylated alpha-amino acid by Sonogashira-type reactions in aqueous media. J Org Chem. Sep. 29, 2006;71(20):7870-3.
Brou et al., A novel proteolytic cleavage involved in Notch signaling: the role of the disintegrin-metalloprotease TACE. Mol Cell. Feb. 2000;5(2):207-16.
Brown, et al. A spiroligomer α-helix mimic that binds HDM2, penetrates human cells and stabilizes HDM2 in cell culture. PLoS One. 2012;7(10):e45948. doi: 10.1371/journal.pone.0045948. Epub Oct. 18, 2012.
Brown, et al. Stapled peptides with improved potency and specificity that activate p53. ACS Chem Biol. Mar. 15, 2013;8(3):506-12. doi: 10.1021/cb3005148. Epub Dec. 18, 2012.
Brubaker et al., Solution structure of the interacting domains of the Mad-Sin3 complex: implications for recruitment of a chromatin-modifying complex. Cell. Nov. 10, 2000;103(4):655-65.
Brunel, et al. Synthesis of constrained helical peptides by thioether ligation: application to analogs of gp41. Chem Commun (Camb). May 28, 2005;(20):2552-4. Epub Mar. 11, 2005.
Brusselle et al., Allergen-induced airway inflammation and bronchial responsiveness in wild-type and interleukin-4-deficient mice. Am J Respir Cell Mol Biol. Mar. 1995;12(3):254.-9.
Bueso-Ramos, et al. (1993). The human MDM-2 oncogene is overexpressed in leukemias. Blood 82, 2617-2623.
Burfield & Smithers, "Desiccant Efficiency in Solvent Drying. 3. Dipolar Aprotic Solvents," J. Org. Chem. 43(20):3966-3968 (1978).
Burger et aL, Synthesis of a-(trifluoromethyl)-substituted a-amino acids. Part 7. An efficient synthesis for a-trifluoromethyl-substituted w-carboxy a-amino acids. Chemiker-Zeitung. 1990;114(3):101-04. German.
Burgess, et al. (2016). Clinical Overview of MDM2/X-Targeted Therapies. Front Oncol. 2016; 6: 7.
Burrage, et al. Biomimetic synthesis of lantibiotics. Chemistry. Apr. 14, 2000;6(8):1455-66.
Cabezas & Satterthwait, "The Hydrogen Bond Mimic Approach: Solid-phase Synthesis of a Peptide Stabilized as an α-Helix with a Hydrazone Link," J. Am. Chem. Soc. 121:3862-3875 (1999).
Campbell, et al. N-alkylated oligoamide alpha-helical proteomimetics. Org Biomol Chem. May 21, 2010;8(10):2344-51. doi: 10.1039/c001164a. Epub Mar. 18, 2010.
Cantel, et al. Synthesis and Conformational Analysis of a Cyclic Peptide Obtained via i to i+4 Intramolecular Side-Chain to Side-Chain Azide-Alkyne 1,3-Dipolar Cycloaddition. JOC Featured Article. Published on the web May 20, 2008.
Caricasole et al., The Wnt pathway, cell-cycle activation and beta-amyloid: novel therapeutic strategies in Alzheimer's disease? Trends Pharmacol Sci. May 2003;24(5):233-8.
Cariello, et al. Resolution of a missense mutant in human genomic DNA by denaturing gradient gel electrophoresis and direct sequencing using in vitro DNA amplification: HPRT Munich. Am J Hum Genet. May 1988;42(5):726-34.
Carillo et al., The Multiple Sequence Alignment Problem in Biology. SIAM J Applied Math. 1988;48:1073-82.
Carlson et al., Specificity landscapes of DNA binding molecules elucidate biological function. Proc Natl Acad Sci USA. Mar. 9, 2010;107(10):4544-9. doi: 10.1073/pnas.0914023107. Epub Feb. 22, 2010.
Carvajal, et al. (2012). E2F7, a novel target, is up-regulated by p53 and mediates DNA damage-dependent transcriptional repression. Genes Dev 26, 1533-1545.
CAS Registry No. 2176-37-6, STN Entry Date Nov. 16, 1984.
CAS Registry No. 2408-85-7, STN Entry Date Nov. 16, 1984.
CAS Registry No. 4727-05-3, STN Entry Date Nov. 16, 1984.
CAS Registry No. 561321-72-0, STN Entry Date Aug. 6, 2003.
CAS Registry No. 721918-14-5, STN Entry Date Aug. 4, 2004.
Chakrabartty et al., "Helix Capping Propensities in Peptides Parallel Those in Proteins," Proc. Nat'l Acad. Sci. USA 90:11332-11336 (1993).
Chakrabartty et al., "Helix Propensities of the Amino Acids Measured in Alanine-based Peptides without Helix-stabilizing Side-chain Interactions," Protein Sci. 3:843-852 (1994).
Chang, et al. (2013). Stapled alpha-helical peptide drug development: a potent dual inhibitor of MDM2 and MDMX for p53-dependent cancer therapy. Proc Natl Acad Sci U S A 110, E3445-3454.
Chang, et al. Stapled α-helical peptide drug development: a potent dual inhibitor of MDM2 and MDMX for p53-dependent cancer therapy. Proc Natl Acad Sci U S A. Sep. 3, 2013;110(36):E3445-54. doi: 10.1073/pnas.1303002110. Epub Aug. 14, 2013.
Chapman et al., "A Highly Stable Short α-Helix Constrained by a Main-chain Hydrogen-bond Surrogate," J. Am. Chem. Soc. 126:12252-12253 (2004).
Chapman, et al. Optimized synthesis of hydrogen-bond surrogate helices: surprising effects of microwave heating on the activity of Grubbs catalysts. Org Lett. Dec. 7, 2006;8(25):5825-8.
Chapman, et al. Trapping a folding intermediate of the alpha-helix: stabilization of the pi-helix. Biochemistry. Apr. 8, 2008;47(14):4189-95. doi: 10.1021/bi800136m. Epub Mar. 13, 2008.
Chen et al., Determination of the helix and beta form of proteins in aqueous solution by circular dichroism. Biochemistry. Jul. 30, 1974;13(16):3350-9.
Chen, et al. Determination of the Secondary Structures of Proteins by Circular Dichroism and Optical Rotatory Dispersion. Biochemistry. 1972; 11(22):4120-4131.
Chen et al., Small molecule-mediated disruption of Wnt-dependent signaling in tissue regeneration and cancer. Nat Chem Biol. Feb. 2009;5(2):100-7. Epub Jan. 4, 2009.
Chen et al., "Structure of the DNA-binding Domains from NFAT, Fos and Jun Bound Specifically to DNA," Nature 392:42-48 (1998).
Cheng et al., Emerging role of RAB GTPases in cancer and human disease. Cancer Res. Apr. 1, 2005;65(7):2516-9.
Cheng et al., The RAB25 small GTPase determines aggressiveness of ovarian and breast cancers. Nat Med. Nov. 2004;10(11):1251-6. Epub Oct. 24, 2004.
Cheon et al., beta-Catenin stabilization dysregulates mesenchymal cell proliferation, motility, and invasiveness and causes aggressive fibromatosis and hyperplastic cutaneous wounds. Proc Natl Acad Sci U S A. May 14, 2002;99(10):6973-8. Epub Apr. 30, 2002.
Chia et al., Emerging roles for Rab family GTPases in human cancer. Biochim Biophys Acta. Apr. 2009;1795(2):110-6.
Chiaramonte et al., Studies of murine schistosomiasis reveal interleukin-13 blockade as a treatment for established and progressive liver fibrosis. Hepatology. Aug. 2001;34(2):273-82.
Chin & Schepartz, "Design and Evolution of a Miniature Bcl-2 Binding Protein," Angew. Chem. Int. Ed. 40(20):3806-3809 (2001).
Chin et al., "Circular Dichroism Spectra of Short, Fixed-nucleus Alanine Helices," Proc. Nat'l Acad. Sci. USA 99(24):15416-15421 (2002).
Chittenden, et al. A conserved domain in Bak, distinct from BH1 and BH2, mediates cell death and protein binding functions. EMBO J. Nov. 15, 1995;14(22):5589-96.
Chène et al., "Study of the Cytotoxic Effect of a Peptidic Inhibitor of the p53-hdm2 Interaction in Tumor Cells," FEBS Lett. 529:293-297 (2002).
Chène, P., "Inhibiting the p53-MDM2 Interaction: An Important Target for Cancer Therapy," Nat Rev. Cancer 3:102-109 (2003).
Cho, et al. An efficient method for removal of ruthenium byproducts from olefin metathesis reactions. Org Lett. Feb. 20, 2003;5(4):531-3.

(56) References Cited

OTHER PUBLICATIONS

Choi, et al. Application of azide-alkyne cycloaddition 'click chemistry' for the synthesis of Grb2 SH2 domain-binding macrocycles. Bioorg Med Chem Lett. Oct. 15, 2006;16(20):5265-9.
Christodoulides et al., WNT10B mutations in human obesity. Diabetologia. Apr. 2006;49(4):678-84. Epub Feb. 14, 2006.
Chu, et al. Peptide-formation on cysteine-containing peptide scaffolds. Orig Life Evol Biosph. Oct. 1999;29(5):441-9.
Clark et al., Supramolecular Design by Covalent Capture. Design of a Peptide Cylinder via Hydrogen-Bond-Promoted Intermolecular Olefin Metathesis. J Am Chem Soc. 1995;117:12364-65.
Clavier, et al. Ring-closing metathesis in biphasic BMI.PF6 ionic liquid/toluene medium: a powerful recyclable and environmentally friendly process. Chem Commun (Camb). Oct. 21, 2004;(20):2282-3. Epub Aug. 25, 2004.
Cleary, et al. Nucleotide sequence of a t(14;18) chromosomal breakpoint in follicular lymphoma and demonstration of a breakpoint-cluster region near a transcriptionally active locus on chromosome 18. Proc Natl Acad Sci U S A. Nov. 1985;82(21):7439-43.
Clevers, Wnt/beta-catenin signaling in development and disease. Cell. Nov. 3, 2006;127(3):469-80.
Cline, et al. Effects of As(III) binding on alpha-helical structure. J Am Chem Soc. Mar. 12, 2003;125(10):2923-9.
Cohn et al., Cutting Edge: IL-4-independent induction of airway hyperresponsiveness by Th2, but not Th1, cells. J Immunol. Oct. 15, 1998;161(8):3813-6.
Colacino, et al. Evaluation of the anti-influenza virus activities of 1,3,4-thiadiazol-2-ylcyanamide (LY217896) and its sodium salt. Antimicrob Agents Chemother. Nov. 1990;34(11):2156-63.
Colaluca et al., NUMB controls p53 tumour suppressor activity. Nature. Jan. 3, 2008;451(7174):76-80. doi: 10.1038/nature06412.
Cole et al., Transcription-independent functions of MYC: regulation of translation and DNA replication. Nat Rev Mol Cell Biol. Oct. 2008;9(10):810-5. Epub Aug. 13, 2008.
Cong et al., A protein knockdown strategy to study the function of beta-catenin in tumorigenesis. BMC Mol Biol. Sep. 29, 2003;4:10.
Conrad, et al. Ruthenium-Catalyzed Ring-Closing Metathesis: Recent Advances, Limitations and Opportunities. Current Organic Chemistry. Jan. 2006; vol. 10, No. 2, 10(2):185-202(18).
Co-pending U.S. Appl. No. 13/494,846, filed Jun. 12, 2012.
Co-pending U.S. Appl. No. 13/655,442, filed Oct. 18, 2010.
Co-pending U.S. Appl. No. 15/229,517, filed Aug. 5, 2016.
Co-pending U.S. Appl. No. 15/233,796, filed Aug. 10, 2016.
Co-pending U.S. Appl. No. 15/256,130, filed Sep. 2, 2016.
Co-pending U.S. Appl. No. 15/257,807, filed Sep. 6, 2016.
Co-pending U.S. Appl. No. 15/259,947, filed Sep. 8, 2016.
Co-pending U.S. Appl. No. 15/332,492, filed Oct. 24, 2016.
Co-pending U.S. Appl. No. 15/349,478, filed Nov. 11, 2016.
Co-pending U.S. Appl. No. 15/463,826, filed Mar. 20, 2017.
Co-pending U.S. Appl. No. 15/493,301, filed Apr. 21, 2017.
Co-pending U.S. Appl. No. 15/592,517, filed May 11, 2017.
Co-pending U.S. Appl. No. 15/625,672, filed Jun. 16, 2017.
Cory et al., "The Bcl-2 Family: Roles in Cell Survival and Oncogenesis," Oncogene 22:8590-8607 (2003).
Cossu et al., Wnt signaling and the activation of myogenesis in mammals EMBO J. Dec. 15, 1999;18(24):6867-72.
Cotton et al. Reactivity of cytosine and thymine in single-base-pair mismatches with hydroxylamine and osmium tetroxide and its application to the study of mutations. PNAS USA 85(12):4397-401 (1988).
Cox et al., Insulin receptor expression by human prostate cancers. Prostate. Jan. 1, 2009;69(1):33-40. doi: 10.1002/pros.20852.
Cummings, et al. Disrupting protein-protein interactions with non-peptidic, small molecule alpha-helix mimetics. Curr Opin Chem Biol. Jun. 2010;14(3):341-6. doi: 10.1016/j.cbpa.2010.04.001. Epub Apr. 27, 2010.
Cusack et al. 2,4,6-Tri-isopropylbenzenesulphonyl Hydrazide: A convenient source of Di-Imide. Tetrahedron. 1976;32:2157-2162.
Danial, et al. Cell death: critical control points. Cell. 2004; 116:204-219.

Danial et al., Dual role of proapoptotic BAD in insulin secretion and beta cell survival. Nat Med. Feb. 2008;14(2):144-53. doi: 10.1038/nm1717. Epub Jan. 27, 2008.
Darnell, Transcription factors as targets for cancer therapy. Nat Rev Cancer. Oct. 2002;2(10):740-9.
Daugherty & Gellman, "A Fluorescence Assay for Leucine Zipper Dimerization: Avoiding Unintended Consequences of Fluorophore Attachment," J. Am. Chem. Soc. 121:4325-4333 (1999).
David et al., Expressed protein ligation. Method and applications. Eur J Biochem. Feb. 2004;271(4):663-77.
Dawson et al., Synthesis of proteins by native chemical ligation. Science. Nov. 4, 1994;266(5186):776-9.
De Guzman et al., Structural basis for cooperative transcription factor binding to the CBP coactivator. J Mol Biol. Feb. 3, 2006;355(5):1005-13. Epub Oct. 5, 2005.
De La O et al., Notch and Kras reprogram pancreatic acinar cells to ductal intraepithelial neoplasia. Proc Natl Acad Sci U S A. Dec. 2, 2008;105(48):18907-12. doi: 10.1073/pnas.0810111105. Epub Nov. 21, 2008.
De Meyts et al., Insulin interactions with its receptors: experimental evidence for negative cooperativity. Biochem Biophys Res Commun. Nov. 1, 1973;55(1):154-61.
De Meyts, The structural basis of insulin and insulin-like growth factor-I receptor binding and negative co-operativity, and its relevance to mitogenic versus metabolic signalling. Diabetologia. Sep. 1994;37 Suppl 2:S135-48.
De Strooper et al., A presenilin-I-dependent gamma-secretase-like protease mediates release of Notch intracellular domain. Nature. Apr. 8, 1999;398(6727):518-22.
Debinski et al., Retargeting interleukin 13 for radioimmunodetection and radioimmunotherapy of human high-grade gliomas. Clin Cancer Res. Oct. 1999;5(10 Suppl):3143s-3147s.
Definition of Analog from http://cancerweb.ncl.ac.uk/cgi-bin/omd?query=analog. pp. 1-5. Accessed Jul. 7, 2005.
Degterev et al. Identification of Small-molecule Inhibitors of Interaction between the BH3 Domain and Bcl-xL. Nature Cell Biol. 3:173-182 (2001).
Deiters, et al. Adding amino acids with novel reactivity to the genetic code of Saccharomyces cerevisiae. J Am Chem Soc. Oct. 1, 2003;125(39):11782-3.
Del Bianco et al., Mutational and energetic studies of Notch 1 transcription complexes. J Mol Biol. Feb. 8, 2008;376(1):131-40. Epub Nov. 28, 2007.
Deng, et al. Cross-Coupling Reaction of Iodo-1,2,3-triazoles Catalyzed by Palladium. Synthesis 2005(16): 2730-2738.
Denmark et al., Cyclopropanation with Diazomethane and Bis(oxazoline)palladium(II) Complexes. J Org Chem. May 16, 1997;62(10):3375-3389.
Dennis et al. Albumin binding as a general strategy for improving the pharmacokinetics of proteins. J Biol Chem. 277(38):35035-35043 (2002).
Designing Custom Peptide. SIGMA Genosys (pp. 1-2) (Accessed Dec. 16, 2004).
Devereux et al., A comprehensive set of sequence analysis programs for the VAX. Nucleic Acids Res. Jan. 11, 1984;12(1 Pt 1):387-95.
Dimartino et al, "A General Approach for the Stabilization of Peptide Secondary Structures," American Chemical Society Meeting, New York (Sep. 2003) (poster).
Dimartino et al. Solid-phase synthesis of hydrogen-bond surrogate-derived alpha-helices. Org Lett. Jun. 9, 2005;7(12):2389-92.
Dombroski et al., Isolation of an active human transposable element. Science. Dec. 20, 1991;254(5039):1805-8.
Doron, et al. Probiotics: their role in the treatment and prevention of disease. Expert Rev Anti Infect Ther. Apr. 2006;4(2):261-75.
Dovey et al., Functional gamma-secretase inhibitors reduce beta-amyloid peptide levels in brain. J Neurochem. Jan. 2001;76(1):173-81.
Duronio, Insulin receptor is phosphorylated in response to treatment of HepG2 cells with insulin-like growth factor I. Biochem J. Aug. 15, 1990;270(1):27-32.
Dyson, et al. Applications of ionic liquids in synthesis and catalysis. Interface-Electrochemical Society. 2007; 16(1), 50-53.

(56) References Cited

OTHER PUBLICATIONS

Eckert & Kim, "Mechanisms of Viral Membrane Fusion and Its Inhibition," Annu. Rev. Biochem. 70:777-810 (2001).
Edlund, et al. Data-driven unbiased curation of the TP53 tumor suppressor gene mutation database and validation by ultradeep sequencing of human tumors. PNAS Early Edition, pp. 1-20.
Eglen et al., The use of AlphaScreen technology in HTS: current status. Curr Chem Genomics. Feb. 25, 2008;1:2-10. doi: 10.2174/1875397300801010002.
Eisenmesser et al., Solution structure of interleukin-13 and insights into receptor engagement. J Mol Biol. Jun. 29, 2001;310(1):231-41.
Ellis et al., Design, synthesis, and evaluation of a new generation of modular nucleophilic glycine equivalents for the efficient synthesis of sterically constrained alpha-amino acids. J Org Chem. Oct. 27, 2006;71(22):8572-8.
Ellisen et al., TAN-1, the human homolog of the *Drosophila* notch gene, is broken by chromosomal translocations in T lymphoblastic neoplasms. Cell. Aug. 23, 1991;66(4):649-61.
Ellman. Tissue sulfhydryl groups. Arch Biochem Biophys. May 1959;82(1):70-7.
Erlanson, et al. Facile synthesis of cyclic peptides containing di-, tri-, tetra-, and Pentasulfides. Tetrahedron Letters. 1998; 39(38):6799-6802.
Erlanson et al., The leucine zipper domain controls the orientation of AP-1 in the NFAT.AP-1.DNA complex. Chem Biol. Dec. 1996;3(12):981-91.
European Medicines Agency, Guideline on the specification limits for residues of metal catalysts or metal regents. Feb. 2008; pp. 1-34.
European Medicines Agency (Pre-authorization Evaluation of Medicines for Human Use, London, Jan. 2007, p. 1-32).
Evans et al., The Rise of Azide—Alkyne 1,3-Dipolar 'Click' Cycloaddition and its Application to Polymer Science and Surface Modification. Australian Journal of Chemistry. 2007;60:384-95.
Faderl, et al. (2000). The prognostic significance of p16(INK4a)/p14(ARF) locus deletion and MDM-2 protein expression in adult acute myelogenous leukemia. Cancer 89, 1976-1982.
Favrin et al., Two-state folding over a weak free-energy barrier. Biophys J. Sep. 2003;85(3):1457-65.
Felix et al., "Synthesis, Biological Activity and Conformational Analysis of Cyclic GRF Analogs," Int. J. Pep. Protein Res. 32:441-454 (1988).
Feng et al. Solid-phase SN2 macrocyclization reactions to form beta-turn mimics. Org Lett. Jul. 15, 1999;1(1):121-4.
Fields, et al. Chapter 3 in Synthetic Peptides: A User's Guide. Grant W.H. Freeman & Co. New York, NY. 1992. p. 77.
Fieser, et al. Fieser and Fieser's Reagents for Organic Synthesis. John Wiley and Sons. 1994.
File Hcaplus on STN. AN No. 1986:572318. Armstrong et al. X=Y-ZH systems as potential 1,3-dipoles. 5. Intramolecular imines of α-amino acid esters. Tetrahedron. 1985; 41(17):3547-58. Abstract only. Abstract date Nov. 1986.
File Hcaplus on STN. AN No. 1990:532752. Burger et al. Synthesis of a-(trifluoromethyl)-substituted a-amino acids. Part 7. An efficient synthesis for a-trifluoromethyl-substituted w-carboxy a-amino acids. Chemiker-Zeitung (1990), 114(3), 101-4. Abstract only, date Oct. 1990.
File Hcaplus on STN. AN No. 1979:168009. Greenlee et al. A general synthesis of alpha-vinyl-alpha-amino acids Tetrahedron Letters (1978), (42), 3999-4002. Abstract date 1984.
Fischbach et al., Specific biochemical inactivation of oncogenic Ras proteins by nucleoside diphosphate kinase. Cancer Res. Jul. 15, 2003;63(14):4089-94.
Fischer et al. Apoptosis-based therapies and drug targets. Cell Death and Differentiation. 2005; 12:942-961.
Fischer et al., The HIV-1 Rev activation domain is a nuclear export signal that accesses an export pathway used by specific cellular RNAs. Cell. Aug. 11, 1995;82(3):475-83.
Fischer, P. Peptide, Peptidomimetic, and Small-molecule Antagonists of the p53-HDM2 Protein-Protein Interaction. Int J Pept Res Ther. Mar. 2006;12(1):3-19. Epub Mar. 15, 2006.

Fisher et al., Myc/Max and other helix-loop-helix/leucine zipper proteins bend DNA toward the minor groove. Proc Natl Acad Sci U S A. Dec. 15, 1992;89(24):11779-83.
Folkers, et al. Methods and principles in medicinal chemistry. Eds. R. Mannhold, H. Kubinyi, and H. Timmerman. Wiley-VCH, 2001.
Formaggio et al., Inversion of 3(10)-helix screw sense in a (D-alpha Me)Leu homo-tetrapeptide induced by a guest D-(alpha Me)Val residue. J Pept Sci. Nov.-Dec. 1995;1(6):396-402.
Friedman-Einat, et al. Target gene identification: target specific transcriptional activation by three murine homeodomain/VP16 hybrid proteins in *Saccharomyces cerevisiae*. J Exp Zool. Feb. 15, 1996;274(3):145-56.
Friedmann et al., RAM-induced allostery facilitates assembly of a notch pathway active transcription complex. J Biol Chem. May 23, 2008;283(21):14781-91. doi: 10.1074/jbc.M709501200. Epub Apr. 1, 2008.
Fromme et al., Structural basis for removal of adenine mispaired with 8-oxoguanine by MutY adenine DNA glycosylase. Nature. Feb. 12, 2004;427(6975):652-6.
Fryer et al., Mastermind mediates chromatin-specific transcription and turnover of the Notch enhancer complex. Genes Dev. Jun. 1, 2002;16(11):1397-411.
Fuchs et al., Socializing with the neighbors: stem cells and their niche. Cell. Mar. 19, 2004;116(6):769-78.
Fulda, et al. Extrinsic versus intrinsic apoptosis pathways in anticancer chemotherapy. Oncogene. Aug. 7, 2006;25(34):4798-811.
Fung et al., Delta-like 4 induces notch signaling in macrophages: implications for inflammation. Circulation. Jun. 12, 2007;115(23):2948-56. Epub May 28, 2007.
Furstner et al., Alkyne Metathesis: Development of a Novel Molybdenum-Based Catalyst System and Its Application to the Total Synthesis of Epothilone A and C. Chem Euro J. 2001;7(24):5299-5317.
Furstner, et al. Mo[N(t-Bu)(AR)]3 Complexes as catalyst precursors: In situ activation and application to metathesis reactions of alkynes and diynes. J Am chem Soc. 1999; 121:9453-54.
Furstner, et al. Nozaki-Hiyama-Kishi reactions catalytic in chromium. J Am Chem Soc. 1996; 118:12349-57.
"Fustero, et al. Asymmetric synthesis of new beta,beta-difluorinated cyclic quaternary alpha-amino acid derivatives. Org Lett. Aug. 31, 2006;8(18):4129-32."
Galande, et al. Thioether side chain cyclization for helical peptide formation: inhibitors of estrogen receptor-coactivator interactions. Journal of Peptide Research. 2004; 63(3): 297-302.
Galande, et al. An effective method of on-resin disulfide bond formation in peptides. J Comb Chem. Mar.-Apr. 2005;7(2):174-7.
Gallivan et al., A neutral, water-soluble olefin metathesis catalyst based on an N-heterocyclic carbene ligand. Tetrahedron Letters. 2005;46:2577-80.
Gallou, et al. A practical method for the removal of ruthenium byproducts by supercritical fluid extraction. Organic Process Research and Development. 2006; 10:937-940.
Galluzzi, et al. Guidelines for the use and interpretation of assays for monitoring cell death in higher eukaryotes. Cell Death Differ. Aug. 2009;16(8):1093-107. Epub Apr. 17, 2009.
Gante, Peptidomimetics—Tailored Enzyme Inhibitors. J Angew Chem Int Ed Engl. 1994;33:1699-1720.
García-Echeverría et al., "Discovery of Potent Antagonists of the Interaction between Human Double Minute 2 and Tumor Suppressor p53," J. Med. Chem. 43:3205-3208 (2000).
Garg et al., Mutations in NOTCH1 cause aortic valve disease. Nature. Sep. 8, 2005;437(7056):270-4. Epub Jul. 17, 2005.
Gat et al., De Novo hair follicle morphogenesis and hair tumors in mice expressing a truncated beta-catenin in skin. Cell. Nov. 25, 1998;95(5):605-14.
Gavathiotis et al., BAX activation is initiated at a novel interaction site. Nature. Oct. 23, 2008;455(7216):1076-81.
Geistlinger & Guy, "An Inhibitor of the Interaction of Thyroid Hormone Receptor β and Glucocorticoid Interacting Protein 1," J. Am. Chem. Soc. 123:1525-1526 (2001).
Gemperli et al., "Paralog-selective Ligands for Bcl-2 Proteins," J. Am. Chem. Soc. 127:1596-1597 (2005).

(56) References Cited

OTHER PUBLICATIONS

Gentle et al., Direct production of proteins with N-terminal cysteine for site-specific conjugation. Bioconjug Chem. May-Jun. 2004;15(3):658-63.
Gerber-Lemaire et al., Glycosylation pathways as drug targets for cancer: glycosidase inhibitors. Mini Rev Med Chem. Sep. 2006;6(9):1043-52.
Ghadiri & Choi, "Secondary Structure Nucleation in Peptides. Transition Metal Ion Stabilized α-Helices," J. Am. Chem. Soc. 112:1630-1632 (1990).
Giannis et aL, Peptidomimetics for Receptor Ligands—Discovery, Development, and Medical Perspectives. Angew Chem Int Ed Engl. 1993;32:1244-67.
Glover & Harrison, "Crystal Structure of the Heterodimeric bZIP Transcription Factor c-Fos-c-Jun Bound to DNA," Nature 373:257-261 (1995).
Goncalves, et al. On-resin cyclization of peptide ligands of the Vascular Endothelial Growth Factor Receptor 1 by copper(I)-catalyzed 1,3-dipolar azide-alkyne cycloaddition. Bioorg Med Chem Lett. Oct. 15, 2007;17(20):5590-4.
Gong et al. LDL receptor-related protein 5 (LRP5) affects bone accrual and eye development. Cell 107:513-523 (Nov. 16, 2001).
Goodson et al., Potential Growth Antagonists. I. Hydantoins and Disubstituted Glycines. J Org Chem. 1960;25:1920-24.
Gorlich et al., Transport between the cell nucleus and the cytoplasm. Annu Rev Cell Dev Biol. 1999;15:607-60.
Goun et al., Molecular transporters: synthesis of oligoguanidinium transporters and their application to drug delivery and real-time imaging. Chembiochem. Oct. 2006;7(10):1497-515.
Gras-Masse, et al. Influence of helical organization on immunogenicity and antigenicity of synthetic peptides. Mol Immunol. Jul. 1988;25(7):673-8.
Greene, et al. Protective Groups in Organic Synthesis, 2nd Ed. John Wiley and Sons. 1991.
Greenfield et al. Computed circular dichroism spectra for the evaluation of protein conformation. Biochemistry. Oct. 8, 1969;(10):4108-4116.
Greenlee et al., A General Synthesis of a-vinyl-a-amino acids. Tetrahedron Letters. 1978;42:3999-40002.
Grossman, et al. Inhibition of oncogenic Wnt signaling through direct targeting of -catenin. Proc. Natl. Acad. Sco. 2012; 109(44):17942-179747.
Grubbs, et al. Ring-Closing Metathesis and Related Processes in Organic Synthesis. Acc. Chem. Res., 1995, 28 (11), pp. 446-452.
Grunig et al., Requirement for IL-13 independently of IL-4 in experimental asthma. Science. Dec. 18, 1998;282(5397):2261-3.
Gu, et al. (2002). Mutual dependence of MDM2 and MDMX in their functional inactivation of p53. J Biol Chem 277, 19251-19254.
Guerlavais, et al. Advancements in Stapled Peptide Drug Discovery & Development. Annual Reports in Medicinal Chemistry, vol. 49 49 (2014): 331-345.
Guinn et al., Synthesis and characterization of polyamides containing unnatural amino acids. Biopolymers. May 1995;35(5):503-12.
Guo et al., Probing the alpha-helical structural stability of stapled p53 peptides: molecular dynamics simulations and analysis. Chem Biol Drug Des. Apr. 2010;75(4):348-59. doi: 10.1111/j.1747-0285.2010.00951.x.
Gupta et al., Long-term effects of tumor necrosis factor-alpha treatment on insulin signaling Gupta pathway in HepG2 cells and HepG2 cells overexpressing constitutively active Akt/PKB. J Cell Biochem. Feb. 15, 2007;100(3):593-607.
Hamard, et al (2012). P53 basic C terminus regulates p53 functions through DNA binding modulation of subset of target genes. J Biol Chem 287, 22397-22407.
Hanessian, et al. Structure-based design and synthesis of macroheterocyclic peptidomimetic inhibitors of the aspartic protease beta-site amyloid precursor protein cleaving enzyme (BACE). J Med Chem. Jul. 27, 2006;49(15):4544-67.
Hara, S. et al. 'Synthetic studies on halopeptins, anti-inflammatory cyclodepsipeptides', Peptide Science. 2006 (vol. date 2005), 42nd, pp. 39-42.
Harper et al., Efficacy of a bivalent LI virus-like particle vaccine in prevention of infection with human papillomavirus types 16 and 18 in young women: a randomized controlled trial. Lancet. Nov. 13-19, 2004;364(9447):1757-65.
Harris et al., Synthesis of proline-modified analogues of the neuroprotective agent glycyl-I-prolyl-glutamic acid (GPE). Tetrahedron. 2005;61:10018-35.
Harrison, et al. Downsizing human, bacterial, and viral proteins to short water-stable alpha helices that maintain biological potency. Proc Natl Acad Sci U S A. Jun. 29, 2010;107(26):11686-91. doi: 10.1073/pnas.1002498107. Epub Jun. 11, 2010.
Hartmann, A Wnt canon orchestrating osteoblastogenesis. Trends Cell Biol. Mar. 2006;16(3):151-8. Epub Feb. 7, 2006.
Hartmann et al., Dual roles of Wnt signaling during chondrogenesis in the chicken limb. Development. Jul. 2000;127(14):3141-59.
Hase; et al., "1,6-Aminosuberic acid analogs of lysine- and arginine-vasopressin and -vasotocin. Synthesis and biological properties. J Am Chem Soc. May 17, 1972;94(10):3590-600."
Haupt, et al. (1997). Mdm2 promotes the rapid degradation of p53. Nature 387, 296-299.
Hein, et al. Copper(I)-Catalyzed Cycloaddition of Organic Azides and 1-Iodoalkynes. Angew Chem Int Ed Engl. 2009;48(43):8018-21.
Hellman et al., Electrophoretic mobility shift assay (EMSA) for detecting protein-nucleic acid interactions. Nat Protoc. 2007;2(8):1849-61.
Hemerka, et al. Detection and characterization of influenza A virus PA-PB2 interaction through a bimolecular fluorescence complementation assay. J Virol. Apr. 2009;83(8):3944-55. doi: 10.1128/JVI.02300-08. Epub Feb. 4, 2009.
Henchey et al., Contemporary strategies for the stabilization of peptides in the a-helical conformation. Curr Opin Chem Biol. 2008;12:692-97.
Henchey, et al. High specificity in protein recognition by hydrogen-bond-surrogate α-helices: selective inhibition of the p53/MDM2 complex. Chembiochem. Oct. 18, 2010;11(15):2104-7. doi: 10.1002/cbic.201000378.
Henchey, et al. Inhibition of Hypoxia Inducible Factor 1-Transcription Coactivator Interaction by a Hydrogen Bond Surrogate α-Helix. J Am Chem Soc. Jan. 27, 2010;132(3):941-3.
Hessa, et al. Recognition of transmembrane helices by the endoplasmic reticulum translocon. Nature. Jan. 27, 2005;433(7024):377-81.
Hilton et al., Notch signaling maintains bone marrow mesenchymal progenitors by suppressing osteoblast differentiation. Nat Med. Mar. 2008;14(3):306-14. doi: 10.1038/nm1716. Epub Feb. 24, 2008.
Hipfner et al., Connecting proliferation and apoptosis in development and disease. Nat Rev Mol Cell Biol. Oct. 2004;5(10):805-15.
Hiroshige, et al. Palladium-mediated macrocyclisations on solid support and its applica-tions to combinatorial synthesis. J. Am. Chem. Soc. 1995; 117:11590-11591.
Hoang et al., Dickkopf 3 inhibits invasion and motility of Saos-2 osteosarcoma cells by modulating the Wnt-beta-catenin pathway. Cancer Res. Apr. 15, 2004;64(8):2734-9.
Holford et al., Adding 'splice' to protein engineering. Structure. Aug. 15, 1998;6(8):951-6.
Honda, et al. Oncoprotein MDM2 is a ubiquitin ligase E3 for tumor suppressor p53. FEBS Lett. Dec. 22, 1997;420(1):25-7.
Hong, et al. Efficient removal of ruthenium byproducts from olefin metathesis products by simple aqueous extraction. Org Lett. May 10, 2007;9(10):1955-7.
Horiguchi, et al. Identification and characterization of the ER/lipid droplet-targeting sequence in 17beta-hydroxysteroid dehydrogenase type 11. Arch Biochem Biophys. Nov. 15, 2008;479(2):121-30. doi: 10.1016/j.abb.2008.08.020. Epub Sep. 10, 2008.
Horne, et al. Foldamers with heterogeneous backbones. Acc Chem Res. Oct. 2008;41(10):1399-408. doi: 10.1021/ar800009n. Epub Jul. 1, 2008.

(56) References Cited

OTHER PUBLICATIONS

Horne, et al. Heterocyclic peptide backbone modifications in an alpha-helical coiled coil. J Am Chem Soc. Dec. 1, 2004;126(47):15366-7.
Horne, et al. Structural and biological mimicry of protein surface recognition by alpha/beta-peptide foldamers. Proc Natl Acad Sci U S A. Sep. 1, 2009;106(35):14751-6. doi: 10.1073/pnas.0902663106. Epub Aug. 17, 2009.
Hoveyda et al., "Ru Complexes Bearing Bidentate Carbenes: From Innocent Curiosity to Uniquely Effective Catalysts for Olefin Metathesis," Org. Biomolec. Chem. 2:8-23 (2004).
Hu, et al. Efficient p53 activation and apoptosis by simultaneous disruption of binding to MDM2 and MDMX. Cancer Res. Sep. 15, 2007;67(18):8810-7.
Huang et al., How insulin binds: the B-chain alpha-helix contacts the L1 beta-helix of the insulin receptor. J Mol Biol. Aug. 6, 2004;341(2):529-50.
Huang et al., Tankyrase inhibition stabilizes axin and antagonizes Wnt signalling. Nature. Oct. 1, 2009;461(7264):614-20. Epub Sep. 16, 2009.
Hunt, S. The Non-Protein Amino Acids. In: Barrett G.C., ed. Chemistry and Biochemistry of the Amino Acids. New York; Chapman and Hall; 1985.
International Preliminary Report on Patentability dated Apr. 14, 2016 for PCT/US2014/058680.
International Preliminary Report on Patentability dated Dec. 17, 2015 for PCT/US2014/41338.
International Preliminary Report on Patentability dated Dec. 23, 2015 for PCT/US2014/042329.
International Preliminary Report on Patentability for PCT/US2008/058575 dated Oct. 8, 2009.
International Preliminary Report on Patentability for PCT/US2009/004260 dated Feb. 3, 2011.
International Preliminary Report on Patentability for PCT/US2010/001952 dated Jan. 26, 2012.
International Preliminary Report on Patentability for PCT/US2011/052755, dated Apr. 4, 2013.
International Preliminary Report on Patentability for PCT/US2012/042719, dated Jan. 3, 2014.
International Preliminary Report on Patentability for PCT/US2012/042738, dated Jan. 3, 2014.
International Preliminary Report on Patentability for PCT/US2013/062004, dated Apr. 9, 2015.
International Preliminary Report on Patentability for PCT/US2013/062929, dated Apr. 16, 2015.
International Preliminary Report on Patentability for PCT/US2014/025544, dated Sep. 24, 2015.
International search report and written opinion dated Feb. 9, 2016 for PCT Application No. PCT/US2015/052018.
International search report and written opinion dated Mar. 3, 2014 for PCT/US2013/068147.
International search report and written opinion dated May 9, 2016 for PCT Application No. PCTUS2016/023275.
International search report and written opinion dated May 23, 2013 for PCT/US2013/026241.
International search report and written opinion dated May 29, 2013 for PCT/US2013/026238.
International search report and written opinion dated Oct. 12, 2011 for PCT/US2011/047692.
International Search Report and Written Opinion dated Nov. 10, 2014 for PCT/US2014/41338.
International Search Report and Written Opinion dated Nov. 24, 2014 for PCT/US2014/042329.
International search report and written opinion dated Dec. 4, 2015 for PCT Application No. PCT/US2015/052031.
International search report and written opinion dated Dec. 6, 2016 for PCT Application No. PCT/US2016/050194.
International Search Report and Written Opinion for PCT/US2008/052580, dated May 16, 2008.
International Search Report and Written Opinion for PCT/US2008/058575 dated Nov. 17, 2008.
International Search Report and Written Opinion for PCT/US2009/004260 dated Oct. 15, 2010.
International Search Report and Written Opinion for PCT/US2010/001952 dated Feb. 2, 2011.
International Search Report and Written Opinion for PCT/US2011/052755 dated Apr. 25, 2012.
International Search Report and Written Opinion for PCT/US2012/042719, dated Nov. 1, 2012.
International Search Report and Written Opinion for PCT/US2012/042738, dated Oct. 18, 2012.
International Search Report and Written Opinion for PCT/US2013/062004, dated Apr. 23, 2014.
International Search Report and Written Opinion for PCT/US2013/062929, dated Jan. 30, 2014.
International Search Report and Written Opinion for PCT/US2014/025544, dated Sep. 10, 2014.
International Search Report and Written Opinion for PCT/US2014/058680, dated Apr. 23, 2015.
International search report dated May 11, 2006 for PCT Application No. US2005/016894.
International search report dated Nov. 30, 2009 for PCT Application No. US2009/02225.
International search report dated Mar. 17, 2010 for PCT Application No. US2009-057931.
International search report dated Apr. 28, 2008 for PCT Application No. US2007/87615.
International search report dated May 18, 2005 for PCT Application No. US2004/38403.
International Search Report dated Sep. 10, 2014 for PCT Application No. US2014/025544.
International search report dated Sep. 25, 2008 for PCT Application No. US2008/54922.
Invitation to Pay Additional Fees for PCT/US2009/004260 dated Mar. 19, 2010.
Invitation to Pay Additional Fees for PCT/US2010/001952 dated Oct. 29, 2010.
Invitation to Pay Additional Fees for PCT/US2011/052755 dated Feb. 16, 2012.
Invitation to Pay Additional Fees for PCT/US2013/062004, dated Jan. 2, 2014.
Invitation to Pay Aditional Fes for PCT/US2014/025544, dated Jul. 22, 2014.
Ishikawa, et al. (2007). Chemotherapy-resistant human AML stem cells home to and engraft within the bone-marrow endosteal region. Nat Biotechnol 25, 1315-1321.
Isidro-Llobet, et al. Amino acid-protecting groups. Chem Rev. Jun. 2009;109(6):2455-504. doi: 10.1021/cr800323s.
Jackson et al. General approach to the synthesis of short alpha-helical peptides. JACS. 1991;113:9391-9392.
Jamieson et al., Granulocyte-macrophage progenitors as candidate leukemic stem cells in blast-crisis CML. N Engl J Med. Aug. 12, 2004;351(7):657-67.
Jensen et al., Activation of the insulin receptor (IR) by insulin and a synthetic peptide has different effects on gene expression in IR-transfected L6 myoblasts. Biochem J. Jun. 15, 2008;412(3):435-45. doi: 10.1042/BJ20080279.
Ji, et al. In vivo activation of the p53 tumor suppressor pathway by an engineered cyclotide. J Am Chem Soc. Aug. 7, 2013;135(31):11623-33. doi: 10.1021/ja405108p. Epub Jul. 25, 2013.
Jin, et al. Structure-based design, synthesis, and activity of peptide inhibitors of RGS4 GAP activity. Methods Enzymol. 2004;389:266-77.
Jin, et al. Structure-based design, synthesis, and pharmacologic evaluation of peptide RGS4 inhibitors. J Pept Res. Feb. 2004;63(2):141-6.
Joerger, et al. Structural biology of the tumor suppressor p53. Annu Rev Biochem. 2008;77:557-82. doi: 10.1146/annurev.biochem.77.060806.091238.
Johannesson, et al. Vinyl sulfide cyclized analogues of angiotensin II with high affinity and full agonist activity at the AT(1) receptor. J Med Chem. Apr. 25, 2002;45(9):1767-77.

(56) References Cited

OTHER PUBLICATIONS

Jones, et al. (1998). Overexpression of Mdm2 in mice reveals a p53-independent role for Mdm2 in tumorigenesis. Proc Natl Acad Sci U S A 95, 15608-15612.

Jordan et al., Wnt4 overexpression disrupts normal testicular vasculature and inhibits testosterone synthesis by repressing steroidogenic factor 1/beta-catenin synergy. Proc Natl Acad Sci U S A. Sep. 16, 2003;100(19):10866-71. Epub Aug. 29, 2003.

Joutel et al., Notch3 mutations in CADASIL, a hereditary adult-onset condition causing stroke and dementia. Nature. Oct. 24, 1996;383(6602):707-10.

Jung, et al. (2013). TXNIP maintains the hematopoietic cell pool by switching the function of p53 under oxidative stress. Cell Metab 18, 75-85.

Junutula et al., Molecular characterization of RabII interactions with members of the family of RabI I-interacting proteins. J Biol Chem. Aug. 6, 2004;279(32):33430-7. Epub Jun. 1, 2004.

Kallen, et al. Crystal structures of human MdmX(HdmX) in complex with p53 peptide analogues reveal surprising conformational changes. Journal of Biological Chemistry. Mar. 27, 2009; 284:8812-8821.

Kanan et al. Reaction discovery enabled by DNA-templated synthesis and in vitro selection. Nature. Sep. 30, 2004;431(7008):545-9.

Kandoth et al. Mutational landscape and significance across 12 major cancer types. Nature 502(7471):333-339 (2013).

Karle, et al. Structural charateristics of alpha-helical peptide molecules containing Aib residues. Biochemistry. Jul. 24, 1990;29(29):6747-56.

Karle. Flexibility in peptide molecules and restraints imposed by hydrogen bonds, the Aib residue, and core inserts. Biopolymers. 1996;40(1):157-80.

Karwoski et al., Lysinonorleucine cross-link formation in alpha amino heptenoic acid-substituted peptide derivatives. Biopolymers. 1978;17(5):1119-27.

Katoh et al., Cross-talk of WNT and FGF signaling pathways at GSK3beta to regulate beta-catenin and SNAIL signaling cascades. Cancer Biol Ther. Sep. 2006;5(9):1059-64. Epub Sep. 4, 2006.

Katsu et al., The human frizzled-3 (FZD3) gene on chromosome 8p21, a receptor gene for Wnt ligands, is associated with the susceptibility to schizophrenia. Neurosci Lett. Dec. 15, 2003;353(1):53-6.

Kaul & Balaram, "Stereochemical Control of Peptide Folding," Bioorg. Med. Chem. 7:105-117 (1999).

Kawamoto, Targeting the BCL9/B9L binding interaction with beta-catenin as a potential anticancer strategy. PhD Thesis. Jun. 3, 2010. Available at http://deepblue.lib.umich.edu/handle/2027.42/75846 last accessed Apr. 9, 2012. Abstract only. 2 pages.

Kazmaier, Sythesis of Quaternary Amino Acids Containing 13, y- as well as 7,6-Unsaturated Side Chains via Chelate-Enolate Claisen Rearrangement. Tetrahedron Letters. 1996;37(30):5351-4.

Kedrowski, B.L. et al. 'Thiazoline ring formation from 2-methylcysteines and 2-halomethylalanines', Heterocycles. 2002, vol. 58, pp. 601-634.

Kelly-Welch et al, Interleukin-4 and Interleukin-13 Signaling Connections Maps. Science. 2003;300:1527-28.

Kelso et al., "A Cyclic Metallopeptide Induces α Helicity in Short Peptide Fragments of Thermolysin," Angew. Chem. Int. Ed. 42(4):421-424 (2003).

Kelso et al., "α-Turn Mimetics: Short Peptide α-Helices Composed of Cyclic Metallopentapeptide Modules," J. Am. Chem. Soc. 126:4828-4842 (2004).

Kemp et al., "Studies of N-Terminal Templates for α-Helix Formation. Synthesis and Conformational Analysis of (2S,5S,8S,11S)-1-Acetyl-1,4-diaza-3-keto-5-carboxy-10-thiatricyclo[2.8.1.04,8]-tridecane (Ac-Hel1-OH)," J. Org. Chem. 56:6672-6682 (1991).

Kemp et al., "Studies of N-Terminal Templates for α-Helix Formation. Synthesis and Conformational Analysis of Peptide Conjugates of (2S,5S,8S,11S)-1-Acetyl-1,4-diaza-3-keto-5-carboxy-10-thiatricyclo[2.8.1.04,8]-tridecane (Ac-Hel1-OH)," J. Org. Chem. 56:6683-6697 (1991).

Kent. Advanced Biology. Oxford University Press. 2000.

Khalil et al., An efficient and high yield method for the N-tert-butoxycarbonyl protection of sterically hindered amino acids. Tetrahedron Lett. 1996;37(20):3441-44.

Kilby et al., "Potent Suppression of HIV-1 Replication in Humans by T-20, a Peptide Inhibitor of gp41-Mediated Virus Entry," Nat. Med. 4(11):1302-1307 (1998).

Kim et al., Introduction of all-hydrocarbon i,i+3 staples into alpha-helices via ring-closing olefin metathesis. Org Lett. Jul. 2, 2010;12(13):3046-9. doi: 10.1021/o11010449.

Kim et al., Stereochemical effects of all-hydrocarbon tethers in i,i+4 stapled peptides. Bioorg Med Chem Lett. May 1, 2009;19(9):2533-6. Epub Mar. 13, 2009.

Kim et al., Synthesis of all-hydrocarbon stapled a-helical peptides by ring-closing olefin metathesis. Nat Protoc. Jun. 2011;6(6):761-71. doi: 10.1038/nprot.2011.324. Epub May 12, 2011.

Kimmerlin et al., '100 years of peptide synthesis': ligation methods for peptide and protein synthesis with applications to beta-peptide assemblies. J Pept Res. Feb. 2005;65(2):229-60.

Kinage, et al. Highly regio-selective synthesis of beta-amino alcohol by reaction with aniline and propylene carbonate in self solvent systems over large pore zeolite catalyst. Green and Sustainable Chem. Aug. 2011;1: 76-84.

Kinzler et al., Identification of FAP locus genes from chromosome 5q21. Science. Aug. 9, 1991;253(5020):661-5.

Kinzler et al., Lessons from hereditary colorectal cancer. Cell. Oct. 18, 1996;87(2):159-70.

Knackmuss et al., Specific inhibition of interleukin-13 activity by a recombinant human single-chain immunoglobulin domain directed against the IL-13 receptor alpha1 chain. Biol Chem. Mar. 2007;388(3):325-30.

Kohler et al., DNA specificity enhanced by sequential binding of protein monomers. Proc Natl Acad Sci U S A. Oct. 12, 1999;96(21):11735-9.

Kolb et al., Click Chemistry: Diverse Chemical Function from a Few Good Reactions. Angew Chem Int Ed Engl. Jun. 1, 2001;40(11):2004-2021.

Kondo et al., Frizzled 4 gene (FZD4) mutations in patients with familial exudative vitreoretinopathy with variable expressivity. Br J Ophthalmol. Oct. 2003;87(10):1291-5.

Konishi et al Gamma-secretase inhibitor prevents Notch3 activation and reduces proliferation in human lung cancers. Cancer Res. Sep. 1, 2007;67(17):8051-7.

Korcsmaros et al., Uniformly curated signaling pathways reveal tissue-specific cross-talks and support drug target discovery. Bioinformatics. Aug. 15, 2010;26(16):2042-50. Epub Jun. 11, 2010.

Korinek et al. Depletion of epithelial stem-cell compartments in the small intestine of mice lacking Tcf-4. Nat Genet 19(4):379-383 (1998).

Kosir, et al. Breast Cancer. Available at https://www.merckmanuals.com/home/women-s-health-issues/breast-disorders/breast-cancer. Accessed on Jun. 29, 2016.

Kotha et al., Modification of constrained peptides by ring-closing metathesis reaction. Bioorg Med Chem Lett. Jun. 4, 2001;11(11):1421-3.

Kouzarides, Acetylation: a regulatory modification to rival phosphorylation? EMBO J. Mar. 15, 2000;19(6):1176-9.

Kovall et al., Crystal structure of the nuclear effector of Notch signaling, CSL, bound to DNA. EMBO J. Sep. 1, 2004;23(17):3441-51. Epub Aug. 5, 2004.

Kozlovsky et aL, GSK-3 and the neurodevelopmental hypothesis of schizophrenia. Eur Neuropsychopharmacol. Feb. 2002;12(1):13-25.

Kristensen et al., Expression and characterization of a 70-kDa fragment of the insulin receptor that binds insulin. Minimizing ligand binding domain of the insulin receptor. J Biol Chem. Jul. 10, 1998;273(28):17780-6.

Kristensen et al., Functional reconstitution of insulin receptor binding site from non-binding receptor fragments. J Biol Chem. May 24, 2002;277(21):18340-5. Epub Mar. 18, 2002.

(56) References Cited

OTHER PUBLICATIONS

Kritzer et al., "Helical β-Peptide Inhibitors of the p53-hDM2 Interaction," J. Am. Chem. Soc. 126:9468-9469 (2004).

Kubbutat, et al. Regulation of p53 stability by Mdm2. Nature. May 15, 1997;387(6630):299-303.

Kudaj, et al. An efficient synthesis of optically pure alpha-alkyl-beta-azido- and alpha-alkyl-beta-aminoalanines via ring opening of 3-amino-3-alkyl-2-oxetanones. Tetrahedron Letters. 2007; 48:6794-6797.

Kurose et al., Cross-linking of a B25 azidophenylalanine insulin derivative to the carboxyl-terminal region of the alpha-subunit of the insulin receptor. Identification of a new insulin-binding domain in the insulin receptor. J Biol Chem. Nov. 18, 1994;269(46):29190-7.

Kussie et al, "Structure of the MDM2 Oncoprotein Bound to the p53 Tumor Suppressor Transactivation Domain," Science 274:948-953 (1996).

Kutchukian et al., All-atom model for stabilization of alpha-helical structure in peptides by hydrocarbon staples. J Am Chem Soc. Apr. 8, 2009;131(13):4622-7.

Kutzki et al., "Development of a Potent Bcl-xL Antagonist Based on α-Helix Mimicry," J. Am. Chem. Soc. 124:11838-11839 (2002).

Kwon, et al. Quantitative comparison of the relative cell permeability of cyclic and linear peptides. Chem Biol. Jun. 2007;14(6):671-7.

Lacombe et al. Reduction of olefins on solid support using diimide. Tetrahedron Letters. 1998;39:6785-6786.

Lammi et al., Mutations in AXIN2 cause familial tooth agenesis and predispose to colorectal cancer. Am J Hum Genet. May 2004;74(5):1043-50. Epub Mar. 23, 2004.

Laporte et al., Molecular and structural basis of cytokine receptor pleiotropy in the interleukin-4/13 system. Cell. Jan. 25, 2008;132(2):259-72.

Larock, R.C. Comprehensive Organic Transformations, New York: VCH Publishers; 1989.

Le Geuzennec et al., Molecular characterization of Sin3 PAH-domain interactor specificity and identification of PAH partners. Nucleic Acids Res. 2006;34(14):3929-37. Epub Aug. 12, 2006.

Le Geuzennec et al., Molecular determinants of the interaction of Mad with the PAH2 domain of mSin3. J Biol Chem. Jun. 11, 2004;279(24):25823-9. Epub Mar. 26, 2004.

Leduc et al., Helix-stabilized cyclic peptides as selective inhibitors of steroid receptor-coactivator interactions. Proc Natl Acad Sci USA. 2003;100(20):11273-78.

Lee, et al. A novel BH3 ligand that selectively targets Mcl-1 reveals that apoptosis can proceed without Mcl-1 degradation. J Cell Biol. Jan. 28, 2008;180(2):341-355.

Lee, et al. Novel pyrrolopyrimidine-based α-helix mimetics: cell-permeable inhibitors of protein-protein interactions. J Am Chem Soc. Feb. 2, 2011;133(4):676-9. doi: 10.1021/ja108230s.

Lenntech BV Water Treatment Solutions. http://www.lenntech.com/periodic/elements/ru.htm.Copyright © 1998-2014.

Lenos, et al. (2012). Alternate splicing of the p53 inhibitor HDMX offers a superior prognostic biomarker than p53 mutation in human cancer. Cancer Res 72, 4074-4084.

Letai, et al. Distinct BH3 Domains Either Sensitize or Activate Mitochondrial Apoptosis, Serving as Prototype Cancer Therapeutics. Cancer Cell. 2002; 2:183-192.

Lewis et al., Apoptosis in T cell acute lymphoblastic leukemia cells after cell cycle arrest induced by pharmacological inhibition of notch signaling. Chem Biol. Feb. 2007;14(2):209-19.

Li, et al. (2012). Activation of p53 by SIRT1 inhibition enhances elimination of CML leukemia stem cells in combination with imatinib. Cancer Cell 21, 266-281.

Li, et al. (2014). MDM4 overexpressed in acute myeloid leukemia patients with complex karyotype and wild-type TP53. PLoS One 9, e113088.

Li; et al., "A versatile platform to analyze low-affinity and transient protein-protein interactions in living cells in real time.", 2014, 9(5):, 1946-58.

Li et al., Alagille syndrome is caused by mutations in human Jagged1, which encodes a ligand for Notch1. Nat Genet. Jul. 1997;16(3):243-51.

Li, et al. Application of Olefin Metathesis in Organic Synthesis. Speciality Petrochemicals. 2007; 79-82 (in Chinese with English abstract).

Li et al., Modulation of Notch signaling by antibodies specific for the extracellular negative regulatory region of NOTCH3. J Biol Chem. Mar. 21, 2008;283(12):8046-54. doi: 10.1074/jbc.M800170200. Epub Jan. 8, 2008.

Li et al., Notch3 signaling promotes the development of pulmonary arterial hypertension. Nat Med. Nov. 2009;15(11):1289-97. doi: 10.1038/nm.2021. Epub Oct. 25, 2009.

Li, et al. Structure-based design of thioether-bridged cyclic phosphopeptides binding to Grb2-SH2 domain. Bioorg Med Chem Lett. Mar. 10, 2003;13(5):895-9.

Li, et al. Systematic mutational analysis of peptide inhibition of the p53-MDM2/MDMX interactions. J Mol Biol. Apr. 30, 2010;398(2):200-13. doi: 10.1016/j.jmb.2010.03.005. Epub Mar. 10, 2010.

Li, et at. Molecular-targeted agents combination therapy for cancer: Developments and potentials. International Journal of Cancer 134.6 (2014): 1257-1269.

Liang et al., Wnt5a inhibits B cell proliferation and functions as a tumor suppressor in hematopoietic tissue. Cancer Cell. Nov. 2003;4(5):349-60.

Lifson & Roig, "On the Theory of Helix-coil Transition in Polypeptides," J. Chem. Phys. 34(6):1963-1974 (1961).

Lindsay et al., Rab coupling protein (RCP), a novel Rab4 and RabII effector protein. J Biol Chem. Apr. 5, 2002;277(14):12190-9. Epub Jan. 10, 2002.

Liskamp, et al. Conformationally restricted amino acids and dipeptides, (non)peptidomimetics and secondary structure mimetics. Recl Travl Chim Pays-Bas. 1994; 113:1-19.

Litowski & Hodges, "Designing Heterodimeric Two-stranded α-Helical Coiled-coils: Effects of Hydrophobicity and α-Helical Propensity on Protein Folding, Stability, and Specificity," J. Biol. Chem. 277(40):37272-37279 (2002).

Little et aL, A Mutation in the LDL Receptor-Related Protein 5 Gene Results in the Autosomal Dominant High-Bone-Mass Trait. Am J Hum Genet. 2002;70:11-19.

Liu, et al. (2009). The p53 tumor suppressor protein is a critical regulator of hematopoietic stem cell behavior. Cell Cycle 8, 3120-3124.

Liu et al., Chemical Ligation Approach to Form a Peptide Bond between Unprotected Peptide Segments. Concept and Model Study. J Am Chem Soc. 1994;116(10):4149-53.

Liu et al., Targeted degradation of beta-catenin by chimeric F-box fusion proteins. Biochem Biophys Res Commun. Jan. 23, 2004;313(4):1023-9.

Lo et al., Phosphorylation by the beta-catenin/MAPK complex promotes 14-3-3-mediated nuclear export of TCF/POP-1 in signal-responsive cells in C. elegans. Cell. Apr. 2, 2004;117(1):95-106.

Logan et al., The Wnt signaling pathway in development and disease. Annu Rev Cell Dev Biol. 2004;20:781-810.

Lohmar et al. Synthese symmetrischerf ketone unter verwendung von 2-Phenyl-2-oxazolin-5-on. (α-Aminosäuren als nucleophile Acyläquivalente, IV. ) Chemische Berichte. 1980;113(12):3706-15.

Losey et al., Crystal structure of *Staphylococcus aureus* tRNA adenosine deaminase TadA in complex with RNA. Nat Struct Mol Biol. Feb. 2006;13(2):153-9. Epub Jan. 15, 2006.

Lou et al., The first three domains of the insulin receptor differ structurally from the insulin-like growth factor 1 receptor in the regions governing ligand specificity. Proc Natl Acad Sci U S A. Aug. 15, 2006;103(33):12429-34. Epub Aug. 7, 2006.

Loughlin et al., Functional variants within the secreted frizzled-related protein 3 gene are associated with hip osteoarthritis in females. Proc Natl Acad Sci U S A. Jun. 29, 2004;101(26):9757-62. Epub Jun. 21, 2004.

Lu et al., Both Pbxl and E2A-Pbx1 bind the DNA motif ATCAATCAA cooperatively with the products of multiple murine Hox genes, some of which are themselves oncogenes. Mol Cell Biol. Jul. 1995;15(7):3786-95.

(56) References Cited

OTHER PUBLICATIONS

Lu, et al. Proteomimetic libraries: design, synthesis, and evaluation of p53-MDM2 interaction inhibitors. J Comb Chem. May-Jun. 2006;8(3):315-25.
Lu et al., Structural determinants within Pbxl that mediate cooperative DNA binding with pentapeptide-containing Hox proteins: proposal for a model of a Pbxl-Hox-DNA complex. Mol Cell Biol. Apr. 1996;16(4):1632-40.
Lubman et al., Quantitative dissection of the Notch:CSL interaction: insights into the Notch-mediated transcriptional switch. J Mol Biol. Jan. 19, 2007;365(3):577-89. Epub Oct. 3, 2006.
Luo, et al. Mechanism of helix induction by trifluoroethanol: a framework for extrapolating the helix-forming properties of peptides from trifluoroethanol/water mixtures back to water. Biochemistry. Jul. 8, 1997;36(27):8413-21.
Luo et al., Wnt signaling and human diseases: what are the therapeutic implications? Lab Invest. Feb. 2007;87(2):97-103. Epub Jan. 8, 2007.
Luo, et al. Wnt signaling and hunian diseases: what are the therapeutic implications? Lab Invest. Feb. 2007;87(2):97-103. Epub Jan. 8, 2007.
Luscher et al., The basic region/helix-loop-helix/leucine zipper domain of Myc proto-oncoproteins: function and regulation. Oncogene. May 13, 1999;18(19):2955-66.
Luu et al, Wnt/beta-catenin signaling pathway as a novel cancer drug target. Curr Cancer Drug Targets. Dec. 2004;4(8):653-71.
Lyu, et al. Capping Interactions in Isolated α Helices: Position-dependent Substitution Effects and Structure of a Serine-capped Peptide Helix. Biochemistry. 1993; 32:421-425.
Lyu et al, "α-Helix Stabilization by Natural and Unnatural Amino Acids with Alkyl Side Chains," Proc. Nat'l Acad. Sci. USA 88:5317-5320 (1991).
MacMillan, Evolving strategies for protein synthesis converge on native chemical ligation. Angew Chem Int Ed Engl. Nov. 27, 2006;45(46):7668-72.
Madden, et al. Synthesis of cell-permeable stapled peptide dual inhibitors of the p53-Mdm2/Mdmx interactions via photoinduced cycloaddition. Bioorg Med Chem Lett. Mar. 1, 2011;21(5):1472-5. doi: 10.1016/j.bmcl.2011.01.004. Epub Jan. 7, 2011.
Mai, et al. A proapoptotic peptide for the treatment of solid tumors. Cancer Research. 2001; 61:7709-7712.
Mangold, et al. Azidoalanine mutagenicity in *Salmonella*: effect of homologation and alpha-Mutat Res. Feb. 1989;216(1):27-33.methyl substitution.
Mannhold, R et al. Molecular Drug Properties: Measurement and Prediction (Methods and Principles in Medicinal Chemistry). Wiley-VCH; 2007.
Marqusee & Baldwin, "Helix Stabilization by Glu- . . . Lys+ Salt Bridges in Short Peptides of De Novo Design," Proc. Nat'l Acad. Sci. USA 84:8898-8902 (1987).
Marshall et al., Back to the future: ribonuclease A. Biopolymers. 2008;90(3):259-77.
Martin, et al. Thermal [2+2] intramolecular cycloadditions of fuller-1,6-enynes. Angew Chem Int Ed Engl. Feb. 20, 2006;45(9):1439-42.
Maynard, et al. Purification technique for the removal of ruthenium from olefin metathesis reaction products. Tetrahedron Letters. 1999; 40:4137-4140.
McGahon, et al. The end of the (cell) line: methods for the study of apoptosis in vitro. Methods Cell Biol. 1995;46:153-85.
McKern et al., Structure of the insulin receptor ectodomain reveals a folded-over conformation. Nature. Sep. 14, 2006;443(7108):218-21. Epub Sep. 6, 2006.
McNamara et al. Peptides constrained by an aliphatic linkage between two C(alpha) sites: design, synthesis, and unexpected conformational properties of an i,(i+4)-linked peptide. J Org Chem. Jun. 29, 2001;66(13):4585-95.
Mellegaard-Waetzig et al., Allylic amination via decarboxylative c-n bond formation Synlett. 2005;18:2759-2762.

Menting et al., A thermodynamic study of ligand binding to the first three domains of the human insulin receptor: relationship between the receptor alpha-chain C-terminal peptide and the site 1 insulin mimetic peptides. Biochemistry. Jun. 16, 2009;48(23):5492-500. doi: 10.1021/bi900261q.
Meyers et al., Formation of mutually exclusive RabII complexes with members of the family of RabII-interacting proteins regulates RabII endocytic targeting and function. J Biol Chem. Dec. 13, 2002;277(50):49003-10. Epub Oct. 9, 2002.
Miller & Scanlan, "oNBS-SPPS: A New Method for Solid-phase Peptide Synthesis," J. Am. Chem. Soc. 120:2690-2691 (1998).
Miller et al., Application of Ring-Closing Metathesis to the Synthesis of Rigidified Amino Acids and Peptides. J Am Chem Soc. 1996;118(40):9606-9614.
Miller et al., Synthesis of Conformationally Restricted Amino Acids and Peptides Employing Olefin Metathesis. J Am Chem Soc. 1995;117(21):5855-5856.
Miloux et al., Cloning of the human IL-13R alpha1 chain and reconstitution with the IL4R alpha of a functional IL-4/IL-13 receptor complex. FEBS Lett. Jan. 20, 1997;401(2-3):163-6.
Miyaoka et al., Increased expression of Wnt-1 in schizophrenic brains. Schizophr Res. Jul. 27, 1999;38(1):1-6.
Moellering et al., Abstract 69. Computational modeling and molecular optimization of stabilized alpha-helical peptides targeting NOTCH-CSL transcriptional complexes. Nov. 2010; 8(7):30. DOI: 10.1016/S1359-6349(10)71774-2. Abstract Only, European Journal of Cancer Supplements, 2010, 8(7).
Moellering et al., Computational modeling and molecular optimization of stabilized alphahelical peptides targeting NOTCH-CSL transcriptional complexes. European Journal of Cancer Supplements Nov. 2010; 8(7):30. DOI: 10.1016/S1359-6349(10)71774-2. Abstract 69.
Moellering et al., Direct inhibition of the NOTCH transcription factor complex. Nature. Nov. 12, 2009;462(7270):182-8. Erratum in: Nature. Jan. 21, 2010;463(7279):384.
Moon et al., WNT and beta-catenin signalling: diseases and therapies. Nat Rev Genet. Sep. 2004;5(9):689-701.
Morin, beta-catenin signaling and cancer. Bioessays. Dec. 1999;21(12):1021-30.
Morita, et al. Cyclolinopeptides B-E, new cyclic peptides from Linum usitatissimum. Tetrahedron 55.4 (1999): 967-976.
Mosberg, et al. Dithioeter-containing cyclic peptides. J. Am. Chem. Soc. 1985;107(10):2986-2987.
Moses, et al. The growing applications of click chemistry. Chem Soc Rev. Aug. 2007;36(8):1249-62.
Moy et al., Solution structure of human IL-13 and implication for receptor binding. J Mol Biol. Jun. 29, 2001;310(1):219-30.
Muchmore, et al. X-ray and NMR structure of human Bcl-xL, an inhibitor of programmed cell death. Nature. May 23, 1996;381(6580):335-41.
Mudher et al., Alzheimer's disease—do tauists and baptists finally shake hands? Trends Neurosci. Jan. 2002;25(1):22-6.
Muir et al., Expressed protein ligation: a general method for protein engineering. Proc Natl Acad Sci U S A. Jun. 9, 1998;95(12):6705-10.
Muir, Semisynthesis of proteins by expressed protein ligation. Annu Rev Biochem. 2003;72:249-89. Epub Feb. 27, 2003.
Muller, P. Glossary of terms used in physical organic chemistry. Pure and Applied Chemistry, 1994, vol. 66, pp. 1077-1184.
Mulqueen et al. Synthesis of the thiazoline-based siderophore (S)-desferrithiocin. 1993;48(24):5359-5364.
Muppidi, et al. Achieving cell penetration with distance-matching cysteine cross-linkers: a facile route to cell-permeable peptide dual inhibitors of Mdm2/Mdmx. Chem Commun (Camb). Sep. 7, 2011;47(33):9396-8. doi: 10.1039/c1cc13320a. Epub Jul. 19, 2011.
Muppidi et al., Conjugation of spermine enhances cellular uptake of the stapled peptide-based inhibitors of p53-Mdm2 interaction. Bioorg Med Chem Lett. Dec. 15, 2011;21(24):7412-5. doi: 10.1016/j.bmcl.2011.10.009. Epub Oct. 12, 2011.
Murray, et al. Targeting protein-protein interactions: lessons from p53/MDM2. Biopolymers. 2007;88(5):657-86.

(56) References Cited

OTHER PUBLICATIONS

Mustapa, et al. Synthesis of a Cyclic Peptide Containing Norlanthionine: Effect of the Thioether Bridge on Peptide Conformation. J. Org. Chem. 2003;68(21):8193-8198.

Mustapa, et al. Synthesis of a cyclic peptide containing norlanthionine: effect of the thioether bridge on peptide conformation. J Org Chem. Oct. 17, 2003;68(21):8193-8.

Mynarcik et al., Alanine-scanning mutagenesis of a C-terminal ligand binding domain of the insulin receptor alpha subunit. J Biol Chem. Feb. 2, 1996;271(5):2439-42.

Mynarcik et al., Identification of common ligand binding determinants of the insulin and insulin-like growth factor 1 receptors. Insights into mechanisms of ligand binding. J Biol Chem. Jul. 25, 1997;272(30):18650-5.

Myriem, V. One pot iodination click reaction: A Convenient Preparation of 5-Iodo-1,4-disubstituted-1,2,3-triazole. Date unknown.

Myung et al., The ubiquitin-proteasome pathway and proteasome inhibitors. Med Res Rev. Jul. 2001;21(4):245-73.

Nair et al., X-ray structures of Myc-Max and Mad-Max recognizing DNA. Molecular bases of regulation by proto-oncogenic transcription factors. Cell. Jan. 24, 2003;112(2):193-205.

Nakashima et al., Cross-talk between Wnt and bone morphogenetic protein 2 (BMP-2) signaling in differentiation pathway of C2C12 myoblasts. J Biol Chem. Nov. 11, 2005;280(45):37660-8. Epub Sep. 2, 2005.

Nam et al., Structural basis for cooperativity in recruitment of MAML coactivators to Notch transcription complexes. Cell. Mar. 10, 2006;124(5):973-83.

Nam et al., Structural requirements for assembly of the CSL. intracellular NotchI.Mastermind-like 1 transcriptional activation complex. J Biol Chem. Jun. 6, 2003;278(23):21232-9. Epub Mar. 18, 2003.

Nefedova et al., Involvement of Notch-1 signaling in bone marrow stroma-mediated de novo drug resistance of myeloma and other malignant lymphoid cell lines. Blood. May 1, 2004;103(9):3503-10. Epub Dec. 11, 2003.

Nelson & Kallenbach, "Persistence of the α-Helix Stop Signal in the S-Peptide in Trifluoroethanol Solutions," Biochemistry 28:5256-5261 (1989).

Ngo et al. Computational complexity, protein structure prediction, and the levinthal paradox. In: The Protein Folding Problem and Tertiary Structure Prediction. K. Merz, Jr., et al. Eds. 1994:433-506.

Ngo et al. Computational complexity, protein structure prediction and the Levinthal Paradox.In: The Protein Folding Problem and Tertiary Structure Prediction. K.Merz, Jr. and S. LeGrand, eds., 1994, pp. 491-495.

Niemann et al., Homozygous WNT3 mutation causes tetra-amelia in a large consanguineous family. Am J Hum Genet. Mar. 2004;74(3):558-63. Epub Feb. 5, 2004.

Nilsson et al., Staudinger ligation: a peptide from a thioester and azide. Org Lett. Jun. 29, 2000;2(13):1939-41.

Niranjan et al., The Notch pathway in podocytes plays a role in the development of glomerular disease. Nat Med. Mar. 2008;14(3):290-8. doi: 10.1038/nm1731. Epub Mar. 2, 2008.

Nishisho et al., Mutations of chromosome 5q21 genes in FAP and colorectal cancer patients. Science. Aug. 9, 1991;253(5020):665-9.

Noah, et al. A cell-based luminescence assay is effective for high-throughput screening of potential influenza antivirals. Antiviral Res. Jan. 2007;73(1):50-9. Epub Jul. 28, 2006.

Nobuo Izimiya et al. Pepuchido Gosei no Kiso to Jikken (Fundamental of peptide synthesis and experiments, Jan. 20, 1985, p. 271.

Node et al., Hard Acid and Soft Nucleophile Systems. 3. Dealkylation of Esters with Aluminum Halide-Thiol and Aluminum Halide-Sulfide Stustems. J Org Chem. 1981;46:1991-93.

Noguera-Troise et al., Blockade of Dll4 inhibits tumour growth by promoting non-productive angiogenesis. Nature. Dec. 21, 2006;444(7122):1032-7.

O'Donnell, et al. Acute Myeloid Leukemia, Version 2.2013: Featured Updates to the NCCN Guidelines. Journal of the National Comprehensive Cancer Network : JNCCN. 2013;11(9):1047-1055.

O'Shea et al., "Mechanism of Specificity in the Fos-Jun Oncoprotein Heterodimer," Cell 68:699-708 (1992).

Okamura et al., Redundant regulation of T cell differentiation and TCRalpha gene expression by the transcription factors LEF-1 and TCF-1. Immunity. Jan. 1998;8(1):11-20.

Oliner, et al. Oncoprotein MDM2 conceals the activation domain of tumour suppressor p53. Nature. Apr. 29, 1993;362(6423):857-60.

Olson et al., Sizing up the heart: development redux in disease. Genes Dev. Aug. 15, 2003;17(16):1937-56. Epub Jul. 31, 2003.

O'Neil & DeGrado, "A Thermodynamic Scale for the Helix-forming Tendencies of the Commonly Occurring Amino Acids," Science 250:646-651(1990).

O'Neil et al., FBW7 mutations in leukemic cells mediate NOTCH pathway activation and resistance to gamma-secretase inhibitors. J Exp Med. Aug. 6, 2007;204(8):1813-24. Epub Jul. 23, 2007.

Or et al. Cysteine alkylation in unprotected peptides: synthesis of a carbavasopressin analogue by intramolecular cystein alkylation. J. Org. Chem. Apr. 1991;56(9):3146-3149.

Oswald et al., RBP-Jkappa/SHARP recruits CtIP/CtBP corepressors to silence Notch target genes. Mol Cell Biol. Dec. 2005;25(23):10379-90.

Pakotiprapha et al., Crystal structure of Bacillus stearothermophilus UvrA provides insight into ATP-modulated dimerization, UvrB interaction, and DNA binding. Mol Cell. Jan. 18, 2008;29(1):122-33. Epub Dec. 27, 2007.

Palchaudhuri et al.,Differentiation induction in acute myeloid leukemia using site-specific DNA-targeting. 55th ASH Annual Meeting and Exposition. Dec. 9, 2013. Accessed at https://ash.confex.com/ash/2013/webprogram/Paper60843.html.

Palomero et al., Mutational loss of PTEN induces resistance to NOTCH1 inhibition in T-cell leukemia. Nat Med. Oct. 2007;13(10):1203-10. Epub Sep. 16, 2007.

Pangborn et al., "Safe and Convenient Procedure for Solvent Purification," Organometallics 15:1518-1520 (1996).

Paquette, L.A., ed. Encyclopedia of Reagents for Organic Synthesis. New York; John Wiley & Sons; 1995.

Park et al., Notch3 gene amplification in ovarian cancer. Cancer Res. Jun. 15, 2006;66(12):6312-8.

Parrish et al., Perspectives on alkyl carbonates in organic synthesis. Tetrahedron, 2000; 56(42): 8207-8237.

Passegue, et al. (2003). Normal and leukemic hematopoiesis: are leukemias a stem cell disorder or a reacquisition of stem cell characteristics? Proc Natl Acad Sci U S A 100 Suppl 1, 11842-11849.

Patgiri, et al. A hydrogen bond surrogate approach for stabilization of short peptide sequences in alpha-helical conformation. Acc Chem Res. Oct. 2008;41(10):1289-300. Epub Jul. 17, 2008.

Patgiri et al. An orthosteric inhibitor of the Ras-Sos interaction. Nat Chem Bio 7:585-587 (2011).

Patgiri, et al. Solid phase synthesis of hydrogen bond surrogate derived alpha-helices: resolving the case of a difficult amide coupling. Org Biomol Chem. Apr. 21, 2010;8(8):1773-6.

Pattenden, et al. Enantioselective synthesis of 2-alkyl substituted cysteines. 1993;49(10):2131-2138.

Pattenden, et al. Naturally occurring linear fused thiazoline-thiazole containing metabolites: total synthesis of (−)-didehydromirabazole A, a cytotoxic alkaloid from blue-green algae. J Chem Soc. 1993;14:1629-1636.

Pazgier, et al. Structural basis for high-affinity peptide inhibition of p53 interactions with MDM2 and MDMX. Proc Natl Acad Sci U S A. Mar. 24, 2009;106(12):4665-70. doi: 10.1073/pnas.0900947106. Epub Mar. 2, 2009.

Peller, et al. (2003). TP53 in hematological cancer: low incidence of mutations with significant clinical relevance. Hum Mutat 21, 277-284.

Pellois et al., Semisynthetic proteins in mechanistic studies: using chemistry to go where nature can't. Curr Opin Chem Biol. Oct. 2006;10(5):487-91. Epub Aug. 28, 2006.

Perantoni, Renal development: perspectives on a Wnt-dependent process. Semin Cell Dev Biol. Aug. 2003;14(4):201-8.

(56) References Cited

OTHER PUBLICATIONS

Peryshkov, et al. Z-Selective olefin metathesis reactions promoted by tungsten oxo alkylidene complexes. Am Chem Soc. Dec. 28, 2011;133(51):20754-7. doi: 10.1021/ja210349m. Epub Nov. 30, 2011.
Peryshkov, et al. Z-Selective olefin metathesis reactions promoted by tungsten oxo alkylidene complexes. J Am Chem Soc. Dec. 28, 2011;133(51):20754-7. doi: 10.1021/ja210349m. Epub Nov. 30, 2011.
Petros et al., "Rationale for Bcl-xL/Bad Peptide Complex Formation from Structure, Mutagenesis, and Biophysical Studies," Protein Sci. 9:2528-2534 (2000).
Phan, et al. Structure-based design of high affinity peptides inhibiting the interaction of p53 with MDM2 and MDMX. J Biol Chem. Jan. 15, 2010;285(3):2174-83. doi: 10.1074/jbc.M109.073056. Epub Nov. 12, 2009.
Phelan, et al. A General Method for Constraining Short Peptides to an α-Helical Conformation. J. Am. Chem. Soc. 1997;119:455-460.
Picksley et al., Immunochemical analysis of the interaction of p53 with MDM2;—fine mapping of the MDM2 binding site on p53 using synthetic peptides. Oncogene. Sep. 1994;9(9):2523-9.
Pillutla et al., Peptides identify the critical hotspots involved in the biological activation of the insulin receptor. J Biol Chem. Jun. 21, 2002;277(25):22590-4. Epub Apr. 18, 2002.
Pinnix et al., Active NotchI confers a transformed phenotype to primary human melanocytes. Cancer Res. Jul. 1, 2009;69(13):5312-20. doi: 10.1158/0008-5472.CAN-08-3767. Epub Jun. 23, 2009.
Plenat, et al. [Formaldehyde fixation in the third millennium]. Ann Pathol. Feb. 2001;21(1):29-47.
Polakis, The oncogenic activation of beta-catenin. Curr Opin Genet Dev. Feb. 1999;9(1):15-21.
Punna, et al. Head-to-tail peptide cyclodimerization by copper-catalyzed azide-alkyne cycloaddition. Angew Chem Int Ed Engl. Apr. 8, 2005;44(15):2215-20.
Qi, J., et al. (2015). HDAC8 Inhibition Specifically Targets Inv(16) Acute Myeloid Leukemic Stem Cells by Restoring p53 Acetylation. Cell Stem Cell 17, 597-610.
Qian & Schellman, "Helix-coil Theories: A Comparative Study for Finite Length Polypeptides," J. Phys. Chem. 96:3987-3994 (1992).
Qiu et al., Convenient, Large-Scale Asymmetric Synthesis of Enantiomerically Pure trans-Cinnamylglycine and -a-Alanine. Tetrahedron. 2000;56:2577-82.
Ran, et al. Double Nicking by RNA-Guided CRISPR Cas9 for Enhanced Genome Editing Specificity. Cell. Aug. 28, 2013. pii: S0092-8674(13)01015-5. doi: 10.1016/j.cell.2013.08.021. [Epub ahead of print].
Rao et al., Inhibition of NOTCH signaling by gamma secretase inhibitor engages the RB pathway and elicits cell cycle exit in T-cell acute lymphoblastic leukemia cells. Cancer Res. Apr. 1, 2009;69(7):3060-8. doi: 10.1158/0008-5472.CAN-08-4295. Epub Mar. 24, 2009.
Rasmussen, et al. Ruthenium-catalyzed cycloaddition of aryl azides and alkynes. Org Lett. Dec. 20, 2007;9(26):5337-9.
Rawlinson et al., CRM1-mediated nuclear export of dengue virus RNA polymerase NS5 modulates interleukin-8 induction and virus production. J Biol Chem. Jun. 5, 2009;284(23):15589-97. Epub Mar. 18, 2009.
Reis, et al. (2016). Acute myeloid leukemia patients' clinical response to idasanutlin (RG7388) is associated with pre-treatment MDM2 protein expression in leukemic blasts. Haematologica 101, e185-188.
Remington: The Science and Practice of Pharmacy. 19th Edition, 1995.
Revised Recommendations of the International Working Group for Diagnosis, Standardization of Response Criteria, Treatment Outcomes, and Reporting Standards for Therapeutic Trials in Acute Myeloid Leukemia. Journal of Clinical Oncology, 22(16), pp. 3432-3433.
Reya et al., Wnt signalling in stem cells and cancer. Nature. Apr. 14, 2005;434(7035):843-50.
Rich et al., Synthesis of the cytostatic cyclic tetrapeptide, chlamydocin. Tetranderon Letts. 1983;24(48):5305-08.
Riddoch, et al. A solid-phase labeling strategy for the preparation of technetium and rhenium bifunctional chelate complexes and associated peptide conjugates. Bioconjug Chem. Jan.-Feb. 2006;17(1):226-35.
Ridgway et al., Inhibition of D114 signalling inhibits tumour growth by deregulating angiogenesis. Nature. Dec. 21, 2006;444(7122):1083-7.
Rink, et al. Lantibiotic Structures as Guidelines for the Design of Peptides That Can Be Modified by Lantibiotic Enzymes. Biochemistry. 2005; 44:8873-8882.
Rivlin, et al. Mutations in the p53 Tumor Suppressor Gene: Important Milestones at the Various Steps of Tumorigenesis. Genes & Cancer 2011, 2:466. Originally published online May 18, 2011.
Robert, A hierarchical "nesting" approach to describe the stability of alpha helices with side-chain interactions. Biopolymers. 1990;30(3-4):335-47.
Roberts, et al. Efficient synthesis of thioether-based cyclic peptide libraries. Tetrahedon Letters. 1998; 39: 8357-8360.
Roberts, et al. Examination of methodology for the synthesis of cyclic thioether peptide libraries derived from linear tripeptides. J Pept Sci. Dec. 2007;13(12):811-21.
Robitaille et al., Mutant frizzled-4 disrupts retinal angiogenesis in familial exudative vitreoretinopathy. Nat Genet. Oct. 2002;32(2):326-30. Epub Aug. 12, 2002.
Rodova et al., The polycystic kidney disease-1 promoter is a target of the beta-catenin/T-cell factor pathway. J Biol Chem. Aug. 16, 2002;277(33):29577-83. Epub Jun. 4, 2002.
Roehrl et al., "A General Framework for Development and Data Analysis of Competitive High-throughput Screens for Small-molecule Inhibitors of Protein-Protein Interactions by Fluorescence Polarization," Biochemistry 43:16056-16066 (2004).
Roehrl et al., "Discovery of Small-molecule Inhibitors of the NFAT-Calcineurin Interaction by Competitive High-throughput Fluorescence Polarization Screening," Biochemistry 43:16067-16075 (2004).
Roice, et al. High Capacity Poly(ethylene glycol) Based Amino Polymers for Peptide and Organic Synthesis. QSAR & Combinatorial Science. 2004;23(8):662-673.
Rojo, et al. Macrocyclic peptidomimetic inhibitors of β-secretase (BACE): First X-ray structure of a macrocyclic peptidomimetic-BACE complex. Bioorg. Med. Chem. Lett. 2006; 16:191-195.
Roof, et al. Mechanism of action and structural requirements of constrained peptide inhibitors of RGS proteins. Chem Biol Drug Des. Apr. 2006;67(4):266-74.
Roos et al., Synthesis of a-Substituted a-Amino Acids via Cationic Intermediates. J Org Chem. 1993;58:3259-68.
Ross et al. Inhibition of adipogenesis by Wnt signaling. Science 289:950-953 (2000).
Rostovtsev et al. A stepwise huisgen cycloaddition process: copper (i)-catalyzed regioselective "ligation" of azides and terminal alkynes. Angew. Chem. Int. Ed. Engl. 41(14):2596-2599 (2002).
Ruan et al., "Metal Ion Enhanced Helicity in Synthetic Peptides Containing Unnatural, Metal-ligating Residues," J. Am. Chem. Soc. 112:9403-9404 (1990).
Rudinger J, "Characteristics of the amino acids as components of a peptide hormone sequence," Peptide Hormones, JA Parsons Edition, University Park Press, Jun. 1976, pp. 1-7.
Ruffolo and Shore. BCL-2 Selectively Interacts with the BID-Induced Open Conformer of BAK, Inhibiting BAK Auto-Oligomerization. J. Biol. Chern. 2003;278(27):25039-25045.
Rutledge et al., "A View to a Kill: Ligands for Bcl-2 Family Proteins," Curr. Opin. Chem. Biol. 6:479-485 (2002).
Rytting, et al. Overview of Leukemia. Available at http://www.merckmanuals.com/home/blood-disorders/leukemias/overview-of%20leukemia?qt=Leukemia&%2520alt=sh. Accessed on Jun. 29, 2016.
Sadot et al., Down-regulation of beta-catenin by activated p53. Mol Cell Biol. Oct. 2001;21(20):6768-81.
Saghiyan, A. S., et al., "New chiral Niii complexes of Schiffs bases of glycine and alanine for efficient asymmetric synthesis of a-amino acids," Tedrahedron: Asymmetry 17: 455-467 (2006).

(56) References Cited

OTHER PUBLICATIONS

Saghiyan, et al. Novel modified (S)-N-(benzoylphenyl)-1-(3,4-dichlorobenzyl)-pyrolidine-2-carboxamide derived chiral auxiliarie for asymmetric synthesis of (S)-alpha-amino acids. Chemical Journal of Armenia. Aug. 2002; 55(3):150-161. (abstract only).
Saiki, et al. Primer-directed enzymatic amplification of DNA with a thermostable DNA polymerase. Science. Jan. 29, 1988;239(4839):487-91.
Sali et al., Stabilization of protein structure by interaction of alpha-helix dipole with a charged side chain. Nature. Oct. 20, 1988;335(6192):740-3.
Sampietro et al., Crystal structure of a beta-catenin/BCL9/Tcf4 complex. Mol Cell. Oct. 20, 2006;24(2):293-300.
Sanchez-Garcia, et al. Tumorigenic activity of the BCR-ABL oncogenes is mediated by BCL2. Proc Natl Acad Sci U S A. Jun. 6, 1995;92(12):5287-91.
Ösapay & Taylor, "Multicyclic Polypeptide Model Compounds. 2. Synthesis and Conformational Properties of a Highly α-Helical Uncosapeptide Constrained by Three Side-chain to Side-chain Lactam Bridges," J. Am. Chem. Soc. 114:6966-6973 (1992).
Satoh et al., AXIN1 mutations in hepatocellular carcinomas, and growth suppression in cancer cells by virus-mediated transfer of AXIN1. Nat Genet. Mar. 2000;24(3):245-50.
Sattler et al. Structure of Bcl-xL-Back peptide complex: recognition between regulators of apoptosis. Science. 275:983-986 (1997).
Sawyer, et al. Macrocyclic a-Helical Peptide Drug Discovery. Macrocycles in Drug Discovery 40 (2014): 339-366.
Saxon et al., Cell surface engineering by a modified Staudinger reaction. Science. Mar. 17, 2000;287(5460):2007-10.
Schaffer et al., A novel high-affinity peptide antagonist to the insulin receptor. Biochem Biophys Res Commun. Nov. 14, 2008;376(2):380-3. doi: 10.1016/j.bbrc.2008.08.151. Epub Sep. 7, 2008.
Schaffer et al., Assembly of high-affinity insulin receptor agonists and antagonists from peptide building blocks. Proc Natl Acad Sci U S A. Apr. 15, 2003;100(8):4435-9. Epub Apr. 8, 2003.
Schafmeister et al. An all-hydrocarbon crosslinking system for enhancing the helicity and metabolic stability of peptides. J. Am Chem. Soc. 2000;122:5891-5892.
Scheffzek et al. The Ras-RasGAP complex: structural basis for GTPase activation and its loss in oncogenic Ras mutants. Science 277(5324):333-338 (1997).
Schinzel et al., The phosphate recognition site of *Escherichia coli* maltodextrin phosphorylase. FEBS Lett. Jul. 29, 1991;286(1-2):125-8.
Schmiedeberg et al. Reversible backbone protection enables combinatorial solid-phase ring-closing metathesis reaction (RCM) in peptides. Org Lett. Jan. 10, 2002;4(1):59-62.
Scholtz et al., The mechanism of alpha-helix formation by peptides. Annu Rev Biophys Biomol Struct. 1992;21:95-118.
Schrock et al., Tungsten(VI) Neopentylidyne Complexes. Organometallics. 1982;1:1645-51.
Schwarzer et al., Protein semisynthesis and expressed protein ligation: chasing a protein's tail. Curr Opin Chem Biol. Dec. 2005;9(6):561-9. Epub Oct. 13, 2005.
Scorrano, et al. A distinct pathway remodels mitochondrial cristae and mobilizes cytochrome c during apoptosis. Dev Cell. Jan. 2002;2(1):55-67.
Scott, et al. A Solid-Phase Synthetic Route to Unnatural Amino Acids with Diverse Side-Chain Substitutions. Journal of Organic Chemistry. 2002, vol. 67, No. 9, pp. 2960-2969.
Scott et al., Evidence of insulin-stimulated phosphorylation and activation of the mammalian target of rapamycin mediated by a protein kinase B signaling pathway. Proc Natl Acad Sci U S A. Jun. 23, 1998;95(13):7772-7.
Seabra et al., Rab GTPases, intracellular traffic and disease. Trends Mol Med. Jan. 2002;8(1):23-30.
Seebach, et al. Beta-peptidic peptidomimetics. Acc Chem Res. Oct. 2008;41(10):1366-75. doi: 10.1021/ar700263g. Epub Jun. 26, 2008.
Seebach, et al. Self-Regeneration of Stereocenters (SRS)—Applications, Limitations, and Abandonment of a Synthetic Principle. Angew. Chem. Int. Ed. Engl. 1996;35:2708-2748.
Seebeck, et al. Ribosomal synthesis of dehydroalanine-containing peptides. J Am Chem Soc. Jun. 7, 2006;128(22):7150-1.
Seiffert et al., Presenilin-1 and -2 are molecular targets for gamma-secretase inhibitors. J Biol Chem. Nov. 3, 2000;275(44):34086-91.
Shair, A closer view of an oncoprotein-tumor suppressor interaction. Chem Biol. Nov. 1997;4(11):791-4.
Shangary, et al. Targeting the MDM2-p53 interaction for cancer therapy. Clin Cancer Res. Sep. 1, 2008;14(17):5318-24. doi: 10.1158/1078-0432.CCR-07-5136.
Sharp, et al. (1999). Stabilization of the MDM2 oncoprotein by interaction with the structurally related MDMX protein. J Biol Chem 274, 38189-38196.
Shenk, et al. Biochemical method for mapping mutational alterations in DNA with S1 nuclease: the location of deletions and temperature-sensitive mutations in simian virus 40. Proc Natl Acad Sci U S A. Mar. 1975;72(3):989-93.
Shepherd et al., "Single Turn Peptide Alpha Helices with Exceptional Stability in Water," J. Am. Chem. Soc. 127:2974-2983 (2005).
Shi, et al. The role of arsenic-thiol interactions in metalloregulation of the ars operant. J Biol Chem. Apr. 19, 1996;271(16):9291-7.
Shiba et al., Structural basis for RabII-dependent membrane recruitment of a family of RabII-interacting protein 3 (FIP3)/Arfophilin-1. Proc Natl Acad Sci U S A. Oct. 17, 2006;103(42):15416-21. Epub Oct. 9, 2006.
Shvarts, et al. (1996). MDMX: a novel p53-binding protein with some functional properties of MDM2. EMBO J 15, 5349-5357.
Si et aL, CCN1/Cyr61 is regulated by the canonical Wnt signal and plays an important role in Wnt3A-induced osteoblast differentiation of mesenchymal stem cells. Mol Cell Biol. Apr. 2006;26(8):2955-64.
Sia et al., "Short Constrained Peptides that Inhibit HIV-1 Entry," Proc. Nat'l Acad. Sci. USA 99(23):14664-14669 (2002).
Siddle et al., Specificity in ligand binding and intracellular signalling by insulin and insulin-like growth factor receptors. Biochem Soc Trans. Aug. 2001;29(Pt 4):513-25.
Singh, et al. Efficient asymmetric synthesis of (S)- and (R)-N-Fmoc-S-trityl-alpha-methylcysteine using camphorsultam as a chiral auxiliary . . . J Org Chem. Jun. 25, 2004;69(13):4551-4.
Singhet al.,Iridium(I)-catalyzed regio- and enantioselective allylic amidation.Tet. Lett. 2007;48(40): 7094-7098.
Skinner et al., Basic helix-loop-helix transcription factor gene family phylogenetics and nomenclature. Differentiation. Jul. 2010;80(1):1-8. doi: 10.1016/j.diff.2010.02.003. Epub Mar. 10, 2010.
Smith, et al. Design, Synthesis, and Binding Affinities of Pyrrolinone-Based Somatostatin Mimetics. Organic Letters. Jan. 8, 2005, vol. 7, No. 3, pp. 399-402, plus Supporting Information, pp. S1-S39.
Smith et al., Structural resolution of a tandem hormone-binding element in the insulin receptor and its implications for design of peptide agonists. Proc Natl Acad Sci U S A. Apr. 13, 2010;107(15):6771-6. doi: 10.1073/pnas.1001813107. Epub Mar. 26, 2010.
Solution phase synthesis from http://www.combichemistry.com/solution_phase_synthesis.html. p. 1. Accessed Aug. 6, 2009.
Soucek et al., Modelling Myc inhibition as a cancer therapy. Nature. Oct. 2, 2008;455(7213):679-83. Epub Aug. 17, 2008.
Sparey et al., Cyclic sulfamide gamma-secretase inhibitors. Bioorg Med Chem Lett. Oct. 1, 2005;15(19):4212-6.
Spierings, et al. Connected to death: the (unexpurgated) mitochondrial pathway of apoptosis. Science. 2005; 310:66-67.
Spouge, et al. Strong conformational propensities enhance t cell antigenicity. J Immunol. Jan. 1, 1987;138(1):204-12.
Stad, et al. (2000). Hdmx stabilizes Mdm2 and p53. J Biol Chem 275, 28039-28044.
Stad, et al. (2001). Mdmx stabilizes p53 and Mdm2 via two distinct mechanisms. EMBO Rep 2, 1029-1034.
Stein et al., Rab proteins and endocytic trafficking: potential targets for therapeutic intervention. Adv Drug Deliv Rev. Nov. 14, 2003;55(11):1421-37.
Stenmark et al., The Rab GTPase family. Genome Biol. 2001;2(5):3007.1-3007.7.

(56) References Cited

OTHER PUBLICATIONS

Stewart, et al. Cell-penetrating peptides as delivery vehicles for biology and medicine. Org Biomol Chem. Jul. 7, 2008;6(13):2242-55. doi: 10.1039/b719950c. Epub Apr. 15, 2008.
Still et al., "Rapid Chromatographic Technique for Preparative Separations with Moderate Resolution," J. Org. Chem. 43(14):2923-2925 (1978).
Still et al., Semianalytical Treatment of Solvation for Molecular Mechanics and Dynamics. J Am Chem Soc. 1990;112:6127-29.
STN search notes for Lu reference, 4 pages, 2006.
Struhl et al., Presenilin is required for activity and nuclear access of Notch in *Drosophila*. Nature. Apr. 8, 1999;398(6727):522-5.
Stueanaes et al., Beta-adrenoceptor stimulation potentiates insulin-stimulated PKB phosphorylation in rat cardiomyocytes via cAMP and PKA. Br J Pharmacol. May 2010;160(1):116-29. doi: 10.1111/j.1476-5381.2010.00677.x.
Stymiest, et al. Supporting information for: Solid Phase Synthesis of Dicarba Analogs of the Biologically Active Peptide Hormone Oxytocin Using Ring Closing Metathesis. Organic Letters. 2003. 1-8.
Stymiest, et al. Synthesis of biologically active dicarba analogues of the peptide hormone oxytocin using ring-closing metathesis. Org Lett. Jan. 9, 2003;5(1):47-9.
Su et al., Eradication of pathogenic beta-catenin by Skp1/Cullin/F box ubiquitination machinery. Proc Natl Acad Sci U S A. Oct. 28, 2003;100(22):12729-34. Epub Oct. 16, 2003.
Surinya et al., Role of insulin receptor dimerization domains in ligand binding, cooperativity, and modulation by anti-receptor antibodies. J Biol Chem. May 10, 2002;277(19):16718-25. Epub Mar. 1, 2002.
Suter, et al. (2011). Mammalian genes are transcribed with widely different bursting kinetics. Science 332, 472-474.
Suzuki, et al. Structure of Bax: coregulation of dimer formation and intracellular localization. Cell. Nov. 10, 2000;103(4):645-54.
Szewczuk, et al. Synthesis and Biological activity of new conformationally restricted analogues of pepstatin. Int. J. Peptide Protein. Res. 1992; 40:233-242.
Takeda et al. Human sebaceous tumors harbor inactivating mutations in LEF I . Nat Med. 12(4):395-397 (2006).
Takeishi, et al. (2013). Ablation of Fbxw7 eliminates leukemia-initiating cells by preventing quiescence. Cancer Cell 23, 347-361.
Tam, et al. Protein prosthesis: 1,5-disubstituted[1,2,3]triazoles as cis-peptide bond surrogates. J Am Chem Soc. Oct. 24, 2007;129(42):12670-1.
Tan, et al. (2014). High Mdm4 levels suppress p53 activity and enhance its half-life in acute myeloid leukaemia. Oncotarget 5, 933-943.
Tanaka, Design and synthesis of non-proteinogenic amino acids and secondary structures of their peptides. Yakugaku Zasshi. Oct. 2006:126(10):931-44. Japanese.
Tanimura, et al. (1999). MDM2 interacts with MDMX through their RING finger domains. FEBS Lett 447, 5-9.
Taylor. The synthesis and study of side-chain lactam-bridged peptides. Biopolymers. 2002;66(1):49-75.
Thallinger, et al. Mcl-1 is a novel therapeutic target for human sarcoma: synergistic inhibition of human sarcoma xenotransplants by a combination of mcl-1 antisense oligonucleotides with low-dose cyclophosphamide. Clin Cancer Res. Jun. 15, 2004;10(12 Pt 1):4185-91.
Therasse, et al. New guidelines to evaluate the response to treatment in solid tumors. European Organization for Research and Treatment of Cancer, National Cancer Institute of the United States, National Cancer Institute of Canada. J Natl Cancer Inst. Feb. 2, 2000;92(3):205-16.
Thompson et al., Mutants of interleukin 13 with altered reactivity toward interleukin 13 receptors. J Biol Chem. Oct. 15, 1999;274(42):29944-50.
Thundimadathil, New Reactions with Click Chemistry. An R&D Magazine Webcast. Oct. 10, 2012. Available at http://www.rdmag.com/articles/2012/10/new-reactions-click-chemistry.

Tian et al., Linear non-competitive inhibition of solubilized human gamma-secretase by pepstatin A methylester, L685458, sulfonamides, and benzodiazepines. J Biol Chem. Aug. 30, 2002;277(35):31499-505. Epub Jun. 18, 2002.
Tian et al.; The role of the Wnt-signaling antagonist DKKI in the development of osteolytic lesions in multiple myeloma. N Engl J Med 349:2483-3494 (2003).
Titus, et al. Human K/natural killer cells targeted with hetero-cross-linked antibodies specifically lyse tumor cells in vitro and prevent tumor growth in vivo. J Immunol. Nov. 1, 1987;139(9):3153-8.
Tolbert et al., New methods for proteomic research: preparation of proteins with N-terminal cysteines for labeling and conjugation. Angew Chem Int Ed Engl. Jun. 17, 2002;41(12):2171-4.
Toniolo, Conformationally restricted peptides through short-range cyclizations. Int J Pept Protein Res. Apr. 1990;35(4):287-300.
Toomes et al., Mutations in LRP5 or FZD4 underlie the common familial exudative vitreoretinopathy locus on chromosome 11q. Am J Hum Genet. Apr. 2004;74(4):721-30. Epub Mar. 11, 2004.
Tornoe et al., Peptidotriazoles on solid phase: [1,2,3]-triazoles by regiospecific copper(i)-catalyzed 1,3-dipolar cycloadditions of terminal alkynes to azides. J Org Chem. May 3, 2002;67(9):3057-64.
Torrance et al., Combinatorial chemoprevention of intestinal neoplasia. Nat Med. Sep. 2000;6(9):1024-8.
Torres, et al. Peptide tertiary structure nucleation by side-chain crosslinking with metal complexation and double "click" cycload-dition. Chembiochem. Jul. 21, 2008;9(11):1701-5.
Trnka & Grubbs, "The Development of L2X2Ru=CHR Olefin Metathesis Catalysts: An Organometallic Success Story," Acc. Chem. Res. 34:18-29 (2001).
Tsuji et al., Antiproliferative activity of REIC/Dkk-3 and its significant down-regulation in non-small-cell lung carcinomas. Biochem Biophys Res Commun. Nov. 23, 2001;289(1):257-63.
Tsuji et al., Synthesis of γ, δ-unsaturated ketones by the intramolecular decarboxylative allylation of allyl β-keto carboxylates and alkenyl allyl carbonates catalyzed by molybdenum, nickel, and rhodium complexes. Chemistry Letters. 1984; 13(10):1721-1724.
Tsuruzoe et al., Insulin receptor substrate 3 (IRS-3) and IRS-4 impair IRS-1- and IRS-2-mediated signaling. Mol Cell Biol. Jan. 2001;21(1):26-38.
Tugyi, et al. The effect of cyclization on the enzymatic degradation of herpes simplex virus glycoprotein D derived epitope peptide. J Pept Sci. Oct. 2005;11(10):642-9.
Turner et al., "Mitsunobu Glycosylation of Nitrobenzenesulfonamides: Novel Route to Amadori Rearrangement Products," Tetrahedron Lett. 40:7039-7042 (1999).
Tyndall et al. Macrocycles mimic the extended peptide conformation recognized by aspartic, serine, cysteine and metallo proteases. Curr Med Chem. Jul. 2001;8(8):893-907.
Tyndall, et al. Over one hundred peptide-activated G protein-coupled receptors recognize ligands with turn structure. Chem Rev. Mar. 2005;105(3):793-826.
Tyndall et al., "Proteases Universally Recognize Beta Strands in Their Active Sites," Chem. Rev. 105:973-999 (2005).
Ueki, et al. Improved synthesis of proline-derived Ni(II) complexes of glycine: versatile chiral equivalents of nucleophilic glycine for general asymmetric synthesis of alpha-amino acids. J Org Chem. Sep. 5, 2003;68(18):7104-7.
Ueki et al., Increased insulin sensitivity in mice lacking p85beta subunit of phosphoinositide 3-kinase. Proc Natl Acad Sci U S A. Jan. 8, 2002;99(1):419-24. Epub Dec. 18, 2001.
Ueki et al., Positive and negative regulation of phosphoinositide 3-kinase-dependent signaling pathways by three different gene products of the p85alpha regulatory subunit. Mol Cell Biol. Nov. 2000;20(21):8035-46.
Uesugi et al., The alpha-helical FXXPhiPhi motif in p53: TAF interaction and discrimination by MDM2. Proc Natl Acad Sci U S A. Dec. 21, 1999;96(26):14801-6.
Ullman et al., Luminescent oxygen channeling immunoassay: measurement of particle binding kinetics by chemiluminescence. Proc Natl Acad Sci U S A. Jun. 7, 1994;91(12):5426-30.
Vaickus et al., Immune markers in hematologic malignancies. Crit Rev Oncol Hematol. Dec. 1991; 11(4):267-97.

(56) References Cited

OTHER PUBLICATIONS

Van Genderen et al., Development of several organs that require inductive epithelial-mesenchymal interactions is impaired in LEF-1-deficient mice. Genes Dev. Nov. 15, 1994;8(22):2691-703.
Van Gijn et al., The wnt-frizzled cascade in cardiovascular disease. Cardiovasc Res. Jul 2002;55(1):16-24.
Van Hoof, et al. Identification of cell surface proteins for antibody-based selection of human embryonic stem cell-derived cardiomyocytes. J Proteome Res. Mar. 5, 2010;9(3):1610-8. doi: 10.1021/pr901138a.
Van Maarseveen, et al. Efficient route to C2 symmetric heterocyclic backbone modified cyclic peptides. Org Lett. Sep. 29, 2005;7(20):4503-6.
Varallo et al., Beta-catenin expression in Dupuytren's disease: potential role for cell-matrix interactions in modulating beta-catenin levels in vivo and in vitro. Oncogene. Jun. 12, 2003;22(24):3680-4.
Vartak et al., Allosteric Modulation of the Dopamine Receptor by Conformationally Constrained Type VI (3-Turn Peptidomimetics of Pro-Leu-Gly-NH2. J Med Chem. 2007;50(26):6725-6729.
Vassilev, et al. (2004). In vivo activation of the p53 pathway by small-molecule antagonists of MDM2. Science 303, 844-848.
Vassilev, et al. In Vivo Activation of the p53 Pathway by Small-molecule Antagonists of MDM2. Science. 2004; 303:844-848.
Venancio et al., Reconstructing the ubiquitin network: cross-talk with other systems and identification of novel functions. Genome Biol. 2009;10(3):R33. Epub Mar. 30, 2009.
Vera, et al. (2016). Single-Cell and Single-Molecule Analysis of Gene Expression Regulation. Annu Rev Genet 50, 267-291.
Verdine et al., Stapled peptides for intracellular drug targets. Methods Enzymol. 2012;503:3-33. doi: 10.1016/B978-0-12-396962-0.00001-X.
Verdine et al. The challenge of drugging undruggable targets in cancer: lessons learned from targeting BCL-2 family members. Clin Cancer Res. 13(24):7264-7270 (2007).
Verma et al., Small interfering RNAs directed against beta-catenin inhibit the in vitro and in vivo growth of colon cancer cells. Clin Cancer Res. Apr. 2003;9(4):1291-300.
Viallet, et al. Tallimustine is inactive in patients with previously treated small cell lung cancer. A phase II trial of the National Cancer Institute of Canada Clinical Trials Group. Lung Cancer. Nov. 1996;15(3):367-73.
Vila-Perello, et al. A minimalist design approach to antimicrobial agents based on a thionin template. J Med Chem. Jan. 26, 2006;49(2):448-51.
Voet D, Voet JG, Biochemistry, Second Edition, John Wiley & Sons, Inc., 1995, pp. 235-241.
Vu, et al. (2013). Discovery of RG7112: A Small-Molecule MDM2 Inhibitor in Clinical Development. ACS Med Chem Lett 4, 466-469.
Walensky et al., A stapled BID BH3 helix directly binds and activates BAX. (2006) Mol Cell 24:199-210.
Walensky, et al. A stapled BID BH3 helix directly binds and activates BAX. Mol. Cell. Oct. 20, 2006;24(2):199-210.
Walensky, et al. Activation of apoptosis in vivo by a hydrocarbon-stapled BH3 helix. Science. Sep. 3, 2004;305(5689):1466-70.
Walensky, et al. Activation of apoptosis in vivo by a hydrocarbon-stapled BH3 helix. Science. 2004;305(5689):1466-1470.
Walker, et al. General method for the synthesis of cyclic peptidomimetic compounds. Tetrahedron Letters. 2001; 42(34):5801-5804.
Walter et al., Critical role for IL-13 in the development of allergen-induced airway hyperreactivity. J Immunol. Oct. 15, 2001;167(8):4668-75.
Wang, 4-Alkyl-2-trichloromethyloxazolidin-5-ones: Valuable Precursors to Enantiomerically Pure C- and N-Protected a-Alkyl Prolines. Synlett. 1999;1:33-36.
Wang, et al. (2011). Fine-tuning p53 activity through C-terminal modification significantly contributes to HSC homeostasis and mouse radiosensitivity. Genes Dev 25, 1426-1438.
Wang, et al. BID: a novel BH3 domain-only death agonist. Genes Dev. Nov. 15, 1996;10(22):2859-69.
Wang et al. Cell permeable Bcl-2 binding peptides: a chemical approach to apoptosis induction in tumor cells. Cancer Res. Mar. 15, 2000;60(6):1498-502.
Wang, et al. "Click" synthesis of small molecule probes for activity-based fingerprinting of matrix metalloproteases. Chem Commun (Camb). Sep. 28, 2006;(36):3783-5.
Wang et al. Enhanced metabolic stability and protein-binding properties of artificial alpha helices derived from a hydrogen-bond surrogate: application to Bcl-xL. Angew Chem Int Ed Engl. Oct. 14, 2005;44(40):6525-9.
Wang, et al. Evaluation of biologically relevant short alpha-helices stabilized by a main-chain hydrogen-bond surrogate. J Am Chem Soc. Jul. 19, 2006;128(28):9248-56.
Wang, et al. Inhibition of HIV-1 fusion 1-15 by hydrogen-bond-surrogate-based alpha helices. Angewandte Chemie International Edition. 2008; 47(10):1879-1882.
Wang et al., Inhibition of p53 degradation by Mdm2 acetylation. FEBS Lett. Mar. 12, 2004;561(1-3):195-201.
Wang, et al. Nucleation and stability of hydrogen-bond surrogate-based alpha-helices. Org Biomol Chem. Nov. 21, 2006;4(22):4074-81.
Wang et al., "Recognition of a Protein Receptor with the Hydrogen Bond Surrogate-based Artificial Alpha-helices," American Chemical Society Meeting, San Diego (Mar. 2005) (poster).
Wang et al., "Recognition of a Protein Receptor with the Hydrogen Bond Surrogate-based Artificial Alpha-helices," Chemical Biology Symposium, Hunter College (Jan. 2005) (poster).
Weaver et al.,Transition metal-catalyzed decarboxylative allylation and benzylation reactions.Chemical Rev. Mar. 9, 2011;111(3):1846-913.
Website: http://www.onelook.com/?w=span&ls=a&loc=home_ac_span, 1 page, Retrieved on Jan. 23, 2016.
Wei et al., Disorder and structure in the RabII binding domain of RabII family interacting protein 2. Biochemistry. Jan. 27, 2009;48(3):549-57. doi: 10.1021/bi8020197.
Wei, et al. tBID, a membrane-targeted death ligand, oligomerizes BAK to release cytochrome c. Genes Dev. Aug. 15, 2000;14(16):2060-71.
Wels, et al. Synthesis of a novel potent cyclic peptide MC4-ligand by ring-closing metathesis. Bioorg. Med. Chem. Lett. 2005; 13: 4221-4227.
Weng et al., Activating mutations of NOTCH1 in human T cell acute lymphoblastic leukemia. Science. Oct. 8, 2004;306(5694):269-71.
Weng et al., Growth suppression of pre-T acute lymphoblastic leukemia cells by inhibition of notch signaling. Mol Cell Biol. Jan. 2003;23(2):655-64.
Wenninger, et al. International Cosmetic Ingredient Dictionary and Handbook. vol. 2, 7th Edition, 1997, published by The Cosmetic, Toiletry, and Fragrance Association.
Westhoff et al., Alterations of the Notch pathway in lung cancer. Proc Natl Acad Sci U S A. Dec. 29, 2009;106(52):22293-8. doi: 10.1073/pnas.0907781106. Epub Dec. 10, 2009.
Wikipedia The Free Encyclopedia. Willgerodt Rearrangement. Available at https://en.wikipedia.org/wiki/Willgerodt_rearrangement. Accessed on Feb. 12, 2013.
Wild et al., "Peptides Corresponding to a Predictive α-Helical Domain of Human Immunodeficiency Virus Type 1 gp41 are Potent Inhibitors of Virus Infection," Proc. Nat'l Acad. Sci. USA 91:9770-9774 (1994).
Wilen et al., Strategies in Optical Resolution. Tetrahedron. 1977;33:2725-36.
Wilen, Tables of Resolving Agents and Optical Resolutions. E.L. Eliel, ed. Universtify of Notre Dame Press, Notre Dame, IN. 1972:268-98.
Williams and Im. Asymmetric Synthesis of Nonsubstituted and α,α-Disubstituted α-Amino Acids via Disatereoselective Glycine Enolate Alkylations. JACS. 1991;113:9276-9286.
Williams et al., Asymmetric synthesis of 2,6-diamino-6-(hydroxymethyl)pimelic acid: assignment of stereochemistry. J Am Chem Soc. 1991;113(18):6976-6981.
Wills-Karp et al., Interleukin-13: central mediator of allergic asthma. Science. Dec. 18, 1998;282(5397):2258-61.

(56) References Cited

OTHER PUBLICATIONS

Wills-Karp, Interleukin-13 in asthma pathogenesis. Immunol Rev. Dec. 2004;202:175-90.
Wills-Karp, The gene encoding interleukin-13: a susceptibility locus for asthma and related traits. Respir Res. 2000;1(1):19-23. Epub Jul. 17, 2000.
Wilson et al., Crystal structure of the CSL-Notch-Mastermind ternary complex bound to DNA. Cell. Mar. 10, 2006;124(5):985-96.
Wilson et al., The FIP3-RabII protein complex regulates recycling endosome targeting to the cleavage furrow during late cytokinesis. Mol Biol Cell. Feb. 2005;16(2):849-60. Epub Dec. 15, 2004.
Woon et al., Linking of 2-oxoglutarate and substrate binding sites enables potent and highly selective inhibition of JmjC histone demethylases. Angew Chem Int Ed Engl. Feb. 13, 2012;51(7):1631-4. doi: 10.1002/anie.201107833. Epub Jan. 12, 2012.
Wu et al., MAML1, a human homologue of *Drosophila* mastermind, is a transcriptional co-activator for NOTCH receptors. Nat Genet. Dec. 2000;26(4):484-9.
Wu, et al. Regiospecific Synthesis of 1,4,5-Trisubstituted-1,2,3-triazole via One-Pot Reaction Promoted by Copper(I) Salt. Synthesis. 2005(8): 1314-1318.
Wu, et al. Studies on New Strategies for the Synthesis of Oligomeric 1,2,3-Triazoles. Synlett 2006(4): 0645-0647.
Wu et al., Therapeutic antibody targeting of individual Notch receptors. Nature. Apr. 15, 2010;464(7291):1052-7. doi: 10.1038/nature08878.
Xi et al., Use of DNA and peptide nucleic acid molecular beacons for detection and quantification of rRNA in solution and in whole cells. Appl Environ Microbiol. Sep. 2003;69(9):5673-8.
Xing, et al. Crystal structure of a beta-catenin/axin complex suggests a mechanism for the beta¬catenin destruction complex. Genes Dev. Nov. 15, 2003;17(22):2753-64. Epub Nov. 4, 2003.
Xiong, et al. (2010). Spontaneous tumorigenesis in mice overexpressing the p53-negative regulator Mdm4. Cancer Res 70, 7148-7154.
Yang, et al. Calculation of protein conformation from circular dichroism. Methods Enzymol. 1986;130:208-69.
Yang et al. Synthesis and helical structure of lactam bridged BH3 peptides derived from pro-apoptotic Bcl-2 family proteins. Bioorg Med Chem Lett. Mar. 22, 2004;14(6):1403-6.
Yang et al., Therapeutic dosing with anti-interleukin-13 monoclonal antibody inhibits asthma progression in mice. J Pharmacol Exp Ther. Apr. 2005;313(1):8-15. Epub Jan. 11, 2005.
Ye et al., Neurogenic phenotypes and altered Notch processing in *Drosophila* Presenilin mutants. Nature. Apr. 8, 1999;398(6727):525-9.
Yee, et al. Efficient large-scale synthesis of BILN 2061, a potent HCV protease inhibitor, by a convergent approach based on ring-closing metathesis. J Org Chem. Sep. 15, 2006;71(19):7133-45.
Yin et al., "Terphenyl-based Helical Mimetics That Disrupt the p53/HDM2 Interaction," Angew. Chem. Int. Ed. 44:2704-2707 (2005).
Yu, et al. Synthesis of macrocyclic natural products by catalyst-controlled stereoselective ring-closing metathesis. Nature. Nov. 2, 2011;479(7371):88-93. doi: 10.1038/nature10563.
Yu et al., The role of Axin2 in calvarial morphogenesis and craniosynostosis. Development. Apr. 2005; 132(8): 1995-2005.
Zamzami et al. The thiol crosslinking agent diamide overcomes the apoptosis-inhibitory effect of Bcl-2 by enforcing mitochondrial permeability transition. Oncogene. Feb. 26, 1998;16(8):1055-63.
Zeisig, et al. (2012). SnapShot: Acute myeloid leukemia. Cancer Cell 22, 698-698 e691.
Zhang, et al. 310 Helix versus alpha-helix: a molecular dynamics study of conformational preferences of Aib and Alanine. J. American Cancer Society. Dec. 1994; 116(26):11915-11921.
Zhang et al., A cell-penetrating helical peptide as a potential HIV-1 inhibitor. J Mol Biol. May 2, 2008;378(3):565-80. doi: 10.1016/j.jmb.2008.02.066. Epub Mar. 6, 2008.
Zhang, et al. A triazole-templated ring-closing metathesis for constructing novel fused and bridged triazoles. Chem Commun (Camb). Jun. 21, 2007;(23):2420-2.
Zhang, et al. Development of a High-throughput Fluorescence Polarization Assay for Bcl-xL. Anal. Biochem. 2002; 307:70-75.
Zhang, et al. Ruthenium-catalyzed cycloaddition of alkynes and organic azides. J Am Chem Soc. Nov. 23, 2005;127(46):15998-9.
Zhang, et al. Targeting p53-MDM2-MDMX loop for cancer therapy. Subcell Biochem. 2014;85:281-319. doi: 10.1007/978-94-017-9211-0_16.
Zhao, et al. (2010). p53 loss promotes acute myeloid leukemia by enabling aberrant self-renewal. Genes Dev 24, 1389-1402.
Zhao, et al. (2015). Small-molecule inhibitors of the MDM2-p53 protein-protein interaction (MDM2 Inhibitors) in clinical trials for cancer treatment. J Med Chem 58, 1038-1052.
Zhou, et al. Identification of ubiquitin target proteins using cell-based arrays. J Proteome Res. 2007; 6:4397-4406.
Zhou et al., Lymphoid enhancer factor 1 directs hair follicle patterning and epithelial cell fate. Genes Dev. Mar. 15, 1995;9(6):700-13.
Zhou et aL, Tyrosine kinase inhibitor STI-571/Gleevec down-regulates the beta-catenin signaling activity. Cancer Lett. Apr. 25, 2003;193(2):161-70.
Zimm & Bragg, "Theory of the Phase Transition between Helix and Random Coil in Polypeptide Chains," J. Chem. Phys. 31(2):526-535 (1959).
Zitzow, et al. Pathogenesis of avian influenza A (H5N1) viruses in ferrets. J Virol. May 2002;76(9):4420-9.
Zor et aL, Solution structure of the KIX domain of CBP bound to the transactivation domain of c-Myb. J Mol Biol. Mar. 26, 2004;337(3):521-34.

* cited by examiner

Human wild type P53 protein sequence

MEEPQSDPSVEPPLSQETFSDLWKLLPENNVLSPLPSQAMDDLMLSPDDIEQWFTEDPGP
DEAPRMPEAAPPVAPAPAAPTPAAPAPAPSWPLSSSVPSQKTYQGSYGFRLGFLHSGTAK
SVTCTYSPALNKMFCQLAKTCPVQLWVDSTPPPGTRVRAMAIYKQSQHMTEVVRRCPHHE
RCSDSDGLAPPQHLIRVEGNLRVEYLDDRNTFRHSVVVPYEPPEVGSDCTTIHYNYMCNS
SCMGGMNRRPILTIITLEDSSGNLLGRNSFEVRVCACPGRDRRTEEENLRKKGEPHHELP
PGSTKRALPNNTSSSPQPKKKPLDGEYFTLQIRGRERFEMFRELNEALELKDAQAGKEPG
GSRAHSSHLKSKKGQSTSRHKKLMFKTEGPDSD

FIGURE 1

PEPTIDOMIMETIC MACROCYCLES AND USES THEREOF

CROSS REFERENCE

This application claims the benefit of U.S. Provisional Patent Application No. 62/136,357, filed on Mar. 20, 2015, and U.S. Provisional Patent Application No. 62/232,275, filed on Sep. 24, 2015, the entirety of each of which is incorporated herein by reference.

SEQUENCE LISTING

The instant application contains a Sequence Listing which has been submitted electronically in ASCII format and is hereby incorporated by reference in its entirety. Said ASCII copy, created on Jun. 24, 2016, is named 35224-806_201_SL.txt and is 1,199,052 bytes in size.

BACKGROUND OF THE INVENTION

The human transcription factor protein p53 induces cell cycle arrest and apoptosis in response to DNA damage and cellular stress, and thereby plays a critical role in protecting cells from malignant transformation. The E3 ubiquitin ligase MDM2 (also known as HDM2 or human double minute 2) negatively regulates p53 function through a direct binding interaction that neutralizes the p53 transactivation activity, leads to export from the nucleus of p53 protein, and targets p53 for degradation via the ubiquitylation-proteasomal pathway. Loss of p53 activity, either by deletion, mutation, or MDM2 overexpression, is the most common defect in human cancers. Tumors that express wild type p53 are vulnerable to pharmacologic agents that stabilize or increase the concentration of active p53. In this context, inhibition of the activities of MDM2 has emerged as a validated approach to restore p53 activity and resensitize cancer cells to apoptosis in vitro and in vivo. MDMX (also known as MDM4, HDM4 or human double minute 4) has more recently been identified as a similar negative regulator of p53, and studies have revealed significant structural homology between the p53 binding interfaces of MDM2 and MDMX. MDMX has also been observed to be overexpressed in human tumors. The p53-MDM2 and p53-MDMX protein-protein interactions are mediated by the same 15-residue alpha-helical transactivation domain of p53, which inserts into hydrophobic clefts on the surface of MDM2 and MDMX. Three residues within this domain of WT p53 (F19, W23, and L26) are essential for binding to MDM2 and MDMX.

Provided herein are compounds capable of binding to and modulating the activity of p53, MDM2 and/or MDMX. Also provided herein are pharmaceutical formulations comprising p53-based peptidomimetic macrocycles that modulate an activity of p53. Also provided herein are pharmaceutical formulations comprising p53-based peptidomimetic macrocycles that inhibit the interactions between p53, MDM2 and/or MDMX proteins. Further, provided herein are methods for treating diseases including but not limited to liquid cancers and other hyperproliferative diseases.

SUMMARY OF THE INVENTION

Described herein are methods of treating a liquid tumor determined to lack a p53 deactivating mutation, in a human subject in need thereof where the method comprises administering to the human subject a pharmaceutical composition comprising a therapeutically effective amount of a peptidomimetic macrocycle or a pharmaceutically acceptable salt thereof, wherein the peptidomimetic macrocycle binds to MDM2 and/or MDMX proteins.

Further disclosed herein are methods of treating a liquid tumor that lacks a p53 deactivating mutation, in a human subject in need thereof where the method comprises administering to the human subject a pharmaceutical composition comprising a therapeutically effective amount of a peptidomimetic macrocycle or a pharmaceutically acceptable salt thereof, wherein the peptidomimetic macrocycle binds to MDM2 and/or MDMX proteins.

Further disclosed herein are methods of treating a liquid tumor that has a p53 deactivating mutation in a p53 gene, in a human subject in need thereof where the method comprises administering to the human subject a pharmaceutical composition comprising a therapeutically effective amount of a peptidomimetic macrocycle or a pharmaceutically acceptable salt thereof, wherein the peptidomimetic macrocycle binds to MDM2 and/or MDMX proteins.

Further disclosed herein are methods of treating a liquid tumor in a human subject in need thereof, where the method comprises administering to the human subject a pharmaceutical composition comprising a therapeutically effective amount of a peptidomimetic macrocycle or a pharmaceutically acceptable salt thereof, where the peptidomimetic macrocycle binds to MDM2 and/or MDMX proteins and where the liquid tumor is not negative for p53 protein expression (such as liquid tumors that express wild-type p53 protein or mutated p53 protein with partial functionality).

Further disclosed herein are methods of treating a liquid tumor in a human subject in need thereof, where the method comprises administering to the human subject a pharmaceutical composition comprising a therapeutically effective amount of a peptidomimetic macrocycle or a pharmaceutically acceptable salt thereof, wherein the peptidomimetic macrocycle binds to MDM2 and/or MDMX proteins and wherein the liquid tumor expresses a p53 protein with a gain of function mutation (such as a super apoptotic p53).

Further disclosed herein are methods of treating a liquid tumor in a human subject in need thereof, wherein the method comprises administering to the human subject a pharmaceutical composition comprising a therapeutically effective amount of a peptidomimetic macrocycle or a therapeutically equivalent amount of a pharmaceutically acceptable salt thereof, where the peptidomimetic macrocycle binds to MDM2 and/or MDMX proteins and wherein the liquid tumor express a p53 protein with a mutation that causes a partial loss of function.

Further disclosed herein are methods of treating a liquid tumor a human subject in need thereof, wherein the method comprises administering to the human subject a pharmaceutical composition comprising a therapeutically effective amount of a peptidomimetic macrocycle or a pharmaceutically acceptable salt thereof, wherein the peptidomimetic macrocycle binds to MDM2 and/or MDMX proteins and wherein cells in the liquid tumor express p53 from only a single genomic copy of the p53 gene (for example where the cells have a copy loss mutation, e.g., are haploinsufficient).

Further disclosed herein are methods of treating a liquid tumor a human subject in need thereof wherein the method comprises administering to the human subject a pharmaceutical composition comprising a therapeutically effective amount of a peptidomimetic macrocycle or a pharmaceutically acceptable salt thereof, where the peptidomimetic macrocycle binds to MDM2 and/or MDMX proteins and wherein the liquid tumor express a p53 protein with one or more silent mutations.

Further disclosed herein are methods of treating a liquid tumor a human subject in need thereof wherein the method comprises administering to the human subject a pharmaceutical composition comprising a therapeutically effective amount of a peptidomimetic macrocycle or a therapeutically equivalent amount of a pharmaceutically acceptable salt thereof, wherein the peptidomimetic macrocycle binds to MDM2 and/or MDMX proteins and where cells in the liquid tumor are negative for p53 expression.

In some embodiments, the cells in the liquid tumor have the p53 deactivating mutation in one copy of the p53 gene. In another embodiment, the cells in the liquid tumor have a second p53 deactivating mutation in a second copy of a p53 gene. In another embodiment, the p53 deactivating mutation in one copy of the p53 gene is the same as the second p53 deactivating mutation in the second copy of a p53 gene. In another embodiment, the p53 deactivating mutation in one copy of the p53 gene is different from the second p53 deactivating mutation in the second copy of a p53 gene. In another embodiment, the p53 deactivating mutation in the p53 gene results in the lack of p53 protein expression from the p53 gene or in expression of partial a p53 protein with partial loss of function. In another embodiment, the second p53 deactivating mutation in the second copy of a p53 gene results in the lack of p53 protein expression from the p53 gene or in expression of partial a p53 protein with partial loss of function.

In some embodiments, the cells of the liquid tumor have at least one mutation in a copy of a p53 gene, where the mutation eliminates or reduces the activity of a p53 protein expressed from the copy of the p53 gene, as compared to wild type p53 expressed from a copy of a non-mutated p53 gene. In another embodiment, the at least one mutation in a copy of a p53 gene is a non-synonymous mutation. In another embodiment, the at least one mutation in a copy of a p53 gene is a synonymous mutation. In another embodiment, the at least one mutation in a copy of a p53 gene is a synonymous mutation, where the synonymous mutation does not change amino acid sequence of a p53 protein expressed from the copy of the p53 gene. In another embodiment, the at least one mutation in a copy of a p53 gene is a synonymous mutation, where the synonymous mutation increases or decreases binding of a micro-RNA to a mRNA. In another embodiment, the at least one mutation in a copy of a p53 gene is a synonymous mutation, where the synonymous mutation alters (e.g., increases or decreases) the half-life of mRNA.

Further disclosed herein are methods of treating a liquid tumor in a human subject in need thereof where the method comprises administering to the human subject a pharmaceutical composition comprising a therapeutically effective amount of a peptidomimetic macrocycle or a therapeutically equivalent amount of a pharmaceutically acceptable salt thereof, where the peptidomimetic macrocycle binds to MDM2 and/or MDMX proteins.

In some embodiments, the peptidomimetic macrocycle disrupts the interaction between p53 and MDM2 and MDMX.

In some embodiments, the method comprises determining the lack of the p53 deactivating mutation in the liquid tumor prior to the administration of the pharmaceutical composition. In another embodiment, determining the lack of the p53 deactivating mutation comprises confirming the presence of wild type p53 in the liquid tumor. In another embodiment, the method comprises determining a presence of a p53 gain of function mutation in the liquid tumor. In another embodiment, the method comprises determining a presence of a deactivating mutation of p53 in the liquid tumor. In another embodiment, the method comprises determining a presence of a copy loss mutation of p53 in the liquid tumor. In another embodiment, the method comprises determining a presence of a partial loss of function mutation of P53 in the liquid tumor. In another embodiment, the method comprises confirming the lack of the p53 deactivating mutation in the liquid tumor prior to the administration of the pharmaceutical composition. In another embodiment, the confirming the lack of the p53 deactivating mutation comprises confirming the presence of wild type p53 in the liquid tumor. In another embodiment, the method comprises confirming a presence of a p53 gain of function mutation in the liquid tumor. In another embodiment, the method comprises confirming a presence of a deactivating mutation of p53 in the liquid tumor. In another embodiment, the method comprises confirming a presence of a copy loss mutation of p53 in the liquid tumor. In another embodiment, the method comprises comprising confirming a presence of a partial loss of function mutation of P53 in the liquid tumor.

In some embodiments, the determining or the confirming is performed within 1-15 months prior to the administration of the pharmaceutical composition. In another embodiment, the determining or the confirming is performed within 1-12 months prior to the administration of the pharmaceutical composition. In another embodiment, the determining or the confirming is performed within 1-3 months prior to the administration of the pharmaceutical composition. In another embodiment, the determining or the confirming is performed within 1 month prior to the administration of the pharmaceutical composition. In another embodiment, the determining or the confirming is performed within 21 days prior to the administration of the pharmaceutical composition. In another embodiment, the determining or the confirming is performed up to about 1 year prior to the administration of the pharmaceutical composition. In another embodiment, the determining or the confirming is performed up to about 2 years prior to the administration of the pharmaceutical composition. In another embodiment, the determining or the confirming is performed up to about 3 years prior to the administration of the pharmaceutical composition.

In some embodiments, the treatment results in re-activation of the p53 pathway, decreased liquid cancer cell proliferation, increased p53 protein, increased p21, and/or increased apoptosis in the human subject.

In some embodiments, the pharmaceutical composition is administered two or three times a week. In another embodiment, the pharmaceutical composition is administered two times a week. In another embodiment, the pharmaceutical composition is administered once every 2 or 3 weeks. In another embodiment, the pharmaceutical composition is administered once every 1 or 2 weeks. In another embodiment, the pharmaceutical composition is administered on days 1, 4, 8, and 11 of a 21-day cycle. In another embodiment, the pharmaceutical composition is administered on days 1, 8, and 15 of a 28-day cycle.

In some embodiments, the amount of the compound administered is about 0.5-30 mg per kilogram body weight of the human subject. In another embodiment, the amount of the compound administered is about 0.5-20 mg per kilogram body weight of the human subject. In another embodiment, the amount of the compound administered is about 0.5-10 mg per kilogram body weight of the human subject. In another embodiment, the amount of the compound administered is about 0.04 mg, about 0.08 mg, about 0.16 mg, about 0.32 mg, about 0.64 mg, about 1.25 mg, about 1.28 mg, about 1.92 mg, about 2.5 mg, about 3.56 mg, about 3.75 mg, about 5.0 mg, about 7.12 mg, about 7.5 mg, about 10 mg, about 14.24 mg, about 15 mg, about 20 mg, or about 30 mg per kilogram body weight of the human subject. In another embodiment, the amount of the compound administered is about 1.92 mg, about 3.75 mg, about 7.5 mg, about 15.0 mg, or about 30.0 mg per kilogram body weight of the human subject and the compound is administered two times a week. In another embodiment, the amount of the compound administered is about 1.28 mg, about 2.56 mg, about 5.0 mg, about 10 mg, or about 20 mg per kilogram body weight of the human subject and the compound is administered two times a week. In another embodiment, the amount of the compound administered is about 1.92 mg, about 3.75 mg, about 7.5 mg, about 15.0 mg, or about 30.0 mg per kilogram body weight of the human subject and the compound is administered once a week. In another embodiment, the amount of the compound administered is about 1.28 mg, about 2.56 mg, about 5.0 mg, about 10 mg, or about 20 mg per kilogram body weight of the human subject and the compound is administered once a week. In another embodiment, the amount of the compound administered is about about 1.92 mg, about 3.75 mg, about 7.5 mg, about 15.0 mg, or about 30.0 mg mg per kilogram body weight of the human subject and the compound is administered once a day three, five or seven times in a seven day period. In another embodiment, the compound is administered intravenously once a day, seven times in a seven day period. In another embodiment, the amount of the compound administered is about 1.28 mg, about 2.56 mg, about 5.0 mg, about 10 mg, or about 20 mg per kilogram body weight of the human subject and the compound is administered once a day three, five or seven times in a seven day period. In another embodiment, the compound is administered intravenously once a day, seven times in a seven day period.

In some embodiments, the compound is administered over a period of 0.25 h, 0.5 h, 1 h, 2 h, 3 h, 4 h, 5 h, 6 h, 7 h, 8 h, 9 h, 10 h, 11 h, or 12 h. In another embodiment, the compound is administered over a period of 0.25-2 h. In another embodiment, the compound is gradually administered over a period of 1 h. In another embodiment, the compound is gradually administered over a period of 2 h.

In some embodiments, the treatment results in about 95%, about 90%, about 85%, about 80%, about 75%, about 70%, about 65%, about 60%, about 55%, about 50%, about 45%, about 40%, about 35%, about 30%, about 25%, about 20%, about 15%, about 10%, or about 5% reduction in the number of liquid cancer cells within a period of 1 month after treatment initiation. In another embodiment, the treatment results in at least about 60%, at least about 65%, at least about 70%, at least about 75%, at least about 80%, at least about 85%, at least about 90%, or at least about 95% reduction in the number of liquid cancer cells within a period of 1 month after treatment initiation. In another embodiment, the treatment results in about 95%, about 90%, about 85%, about 80%, about 75%, about 70%, about 65%, about 60%, about 55%, about 50%, about 45%, about 40%, about 35%, about 30%, about 25%, about 20%, about 15%, about 10%, or about 5% reduction in the number of liquid cancer cells within a period of 1 year after treatment initiation. In another embodiment, the treatment results in at least about 60%, at least about 65%, at least about 70%, at least about 75%, at least about 80%, at least about 85%, at least about 90%, or at least about 95% reduction in the number of liquid cancer cells within a period of 1 year after treatment initiation. In another embodiment, the treatment results in about 95%, about 90%, about 85%, about 80%, about 75%, about 70%, about 65%, about 60%, about 55%, about 50%, about 45%, about 40%, about 35%, about 30%, about 25%, about 20%, about 15%, about 10%, or about 5% reduction the number of liquid cancer cells within a period of 6 months after treatment initiation. In another embodiment, the treatment results in at least about 60%, at least about 65%, at least about 70%, at least about 75%, at least about 80%, at least about 85%, at least about 90%, or at least about 95% reduction in the number of liquid cancer cells within a period of 6 months after treatment initiation. In another embodiment, the treatment results in about 95%, about 90%, about 85%, about 80%, about 75%, about 70%, about 65%, about 60%, about 55%, about 50%, about 45%, about 40%, about 35%, about 30%, about 25%, about 20%, about 15%, about 10%, or about 5% reduction in the number of liquid cancer cells within a period of 3 months after treatment initiation. In another embodiment, the treatment results in at least about 60%, at least about 65%, at least about 70%, at least about 75%, at least about 80%, at least about 85%, at least about 90%, or at least about 95% reduction in the number of liquid cancer cells within a period of 3 months after treatment initiation.

In some embodiments, the liquid cancer is a stable disease.

In some embodiments, the treatment results in an increased survival time of the human subject as compared to the expected survival time of the human subject if the human subject was not treated with the compound. In another embodiment, the increase in the survival time of the human subject is at least 30 days. In another embodiment, the increase in the survival time of the human subject is at least 3 months. In another embodiment, the increase in the survival time of the human subject is at least 6 months. In another embodiment, the increase in the survival time of the human subject is at least 1 year.

In some embodiments, the in vivo circulating half-life of the compound is about 1 h, 2 h, 3 h, 4 h, 5 h, 6 h, 7 h, 8 h, 9 h, 10 h or 12 h. In another embodiment, the in vivo circulating half-life of the compound is about 4 h. In another embodiment, in vivo circulating the half-life of the compound is about 6 h.

In some embodiments, the biological tissue half-life of the compound is about 1 h, 2 h, 3 h, 4 h, 5 h, 6 h, 7 h, 8 h, 9 h, 10 h or 12 h. In another embodiment, the biological tissue half-life of the compound is about 10 h.

In some embodiments, the human subject is refractory and/or intolerant to one or more other treatment of the liquid cancer. In another embodiment, the human subject has had at least one unsuccessful prior treatment and/or therapy of the liquid cancer.

In some embodiments, the liquid cancer expresses wild-type p53 protein.

In some embodiments, the liquid cancer is selected from a group consisting of liquid lymphoma, leukemia, and myeloma. In another embodiment, the liquid cancer is a liquid lymphoma. In another embodiment, the liquid cancer is a leukemia. In another embodiment, the liquid cancer is an acute leukemia. In another embodiment, the acute leukemia is an acute myeloid leukemia (AML). In another embodiment, the acute leukemia is an acute lymphoid leukemia (ALL). In another embodiment, the liquid cancer is a myeloma. In another embodiment, the liquid cancer is not a HPV positive cancer. In another embodiment, the liquid cancer is not HPV positive cervical cancer, HPV positive anal cancer or HPV positive head and neck cancer, such as oropharyngeal cancers.

In some embodiments, the compound is administered intravenously.

In some embodiments, the method further comprises administering in addition to the compound, a therapeutically effective amount of at least one additional therapeutic agent and/or therapeutic procedure to the human subject.

In some embodiments, the human subject exhibits a complete response to the treatment.

In another embodiment, the human subject exhibits a partial response to the treatment.

In some embodiments, the liquid cancer is a progressive disease. In another embodiment, the liquid cancer is a stable disease.

In some embodiments, the method further comprises determining clinical activity of the administered compound. In another embodiment, the clinical activity is determined by an imaging method selected from a group consisting of computed tomography (CT), magnetic resonance imaging (MRI), bone scanning, and positron emission tomography (PET) scan. In another embodiment, the PET scan uses one or more tracers. In another embodiment, the one or more tracers comprises $^{18}$F-fluorodeoxyglucose (FDG), $^{64}$Cu diacetyl-bis(N$^4$-methylthiosemicarbazone) (ATSM), $^{18}$F-fluoride, 3'-deoxy-3'-[$^{18}$F]fluorothymidine (FLT), $^{18}$F-fluoromisonidazole (FMISO), Gallium, Technetium-99m, or Thallium.

In another embodiment, the method further comprises obtaining a biological sample from the human subject at one or more specific time-points and analyzing the biological sample with an analytical procedure. In another embodiment, the analytical procedure is selected from a group comprising blood chemistry analysis, chromosomal translocation analysis, needle biopsy, tissue biopsy, fluorescence in situ hybridization, laboratory biomarker analysis, immunohistochemistry staining method, flow cytometry, or a combination thereof. In another embodiment, the method comprises tabulating and/or plotting results of the analytical procedure. In another embodiment, the one or more specific time-points comprise a time-point before the administration of the compound to the human subject. In another embodiment, the one or more specific time-points comprise a time-point after the administration of the compound to the human subject. In another embodiment, the one or more specific time-points comprise a time-point before and a time-point after the administration of the compound to the human subject. In another embodiment, the method further comprises comparing the biological samples collected before and after the administration of the compound to the human subject. In another embodiment, the one or more specific time-points comprise multiple time-points before and after the administration of the compound to the human subject. In another embodiment, the method further comprises comparing the biological samples collected at the multiple time-points. In another embodiment, the biological sample is used for biomarker assessment. In another embodiment, the biological sample is used for pharmacokinetic assessment. In another embodiment, the pharmacokinetic assessment comprises studying the level of the peptidomimetic macrocycle and/or its metabolites in the biological sample at the specific time-points. In another embodiment, the biological sample is a blood sample or a bone marrow sample. In another embodiment, the biological sample is used for pharmacodynamic assessment. In another embodiment, the pharmacodynamic assessment comprises studying the level of p53, MDM2, MDMX, p21 and/or caspase in the biological sample at the specific time-points. In another embodiment, the biological sample is a liquid cancer cell specimen. In another embodiment, the biological sample is used for immunogenicity assays.

In some embodiments, the method further comprises selecting and/or identifying at least one circulating tumor cells (CTC) or a mononuclear blood cells (MNBC) in the human subject prior to the administration of the compound to the human subject. In another embodiment, the method further comprises measuring the number of circulating tumor cells (CTCs) or mononuclear blood cells (MNBCs) at one or more specific time-points, where the number of circulating tumor cells (CTCs) or mononuclear blood cells (MNBCs) is the total number of at least one circulating tumor cells (CTC) or a mononuclear blood cells (MNBC) at the specific time-point. In another embodiment, the method further comprises measuring a baseline sum diameter, where the baseline sum diameter is a sum of the diameters of the at least one circulating tumor cells (CTC) or a mononuclear blood cells (MNBC) prior to the administration of the compound to the human subject. In another embodiment, the treatment results in disappearance of the least one circulating tumor cells (CTC) or a mononuclear blood cells (MNBC). In another embodiment, the treatment the number of CTCs and/or MNBCs is reduced. In another embodiment, the one or more specific time-points, comprise a time-point after the treatment. In another embodiment, the number of CTCs and/or MNBCs at the time-point after the treatment is at least 30% less than the baseline number of CTCs and/or MNBCs. In another embodiment, the treatment results in neither sufficient increase nor a sufficient decrease in the number of CTCs and/or MNBCs at the one or more specific time-points, taking as reference the baseline number of CTCs and/or MNBCs.

In some embodiments, the peptidomimetic macrocycle is not an inhibitor of cytochrome P450 isoforms.

In some embodiments, the treatment results in essentially no dose-limiting thrombocytopenia. In another embodiment, the treatment causes essentially no adverse effects in a normal-hematopoietic organ and/or tissue. In another embodiment, the treatment results in essentially no adverse event in the human subject that is possibly, probably, or definitely related to the administration of the compound. In another embodiment, the treatment results in essentially no serious adverse event in the human subject that is probably, probably, or definitely related to the administration of the compound.

In some embodiments, the lack of p53 deactivation mutation in the liquid cancer is determined by DNA sequencing of the nucleic acid encoding the p53 protein. In another embodiment, the lack of p53 deactivation mutation in the liquid cancer is determined by RNA array based testing. In another embodiment, the lack of p53 deactivation mutation in the liquid cancer is determined by RNA analysis. In another embodiment, the lack of p53 deactivation mutation in the liquid cancer is determined by polymerase chain reaction (PCR). In another embodiment, the p53 deactivating mutation comprises mutations in DNA-binding domain of the protein. In another embodiment, the p53 deactivating mutation comprises missense mutation. In another embodiment, the p53 deactivating mutation is a dominant deactivating mutation. In another embodiment, the p53 deactivating mutation comprises one or more mutations selected from a groups consisting of V173L, R175H, G245C, R248W, R249S and R273H. In another embodiment, the p53 deactivating mutation comprises one or more of mutations shown in Table 1.

Also disclosed herein are methods of treating liquid cancer in a human subject determined to lack a p53 deactivating mutation, where the method comprises administering to the human subject 0.5-20 mg of a peptidomimetic macrocycle per kilogram body weight of the human subject or a pharmaceutically acceptable salt thereof on days 1, 8 and 15 of a 28-day cycle.

In some embodiments, the peptidomimetic macrocycle per kilogram body weight of the human subject or a pharmaceutically acceptable salt thereof is administered to the human subject.

In some embodiments, the amount of the peptidomimetic macrocycle entered on day 8 and/or day 15 is greater than the amount of the peptidomimetic macrocycle entered on day 1. In another embodiment, the amount of the peptidomimetic macrocycle entered on day 8 and/or day 15 is equal than the amount of the peptidomimetic macrocycle entered on day 1. In another embodiment, the amount of the peptidomimetic macrocycle entered on day 1 and/or day 8 is greater than the amount of the peptidomimetic macrocycle entered on day 15. In another embodiment, equal amounts of the peptidomimetic macrocycle are administered on days 1, 8 and 15.

In some embodiments, the 28-day cycle is repeated 2 or 3 times.

Also disclosed herein are methods of treating liquid cancer in a human subject determined to lack a p53 deactivating mutation, where the method comprises administering to the human subject 0.25-10 mg of a peptidomimetic macrocycle per kilogram body weight of the human subject or a pharmaceutically acceptable salt thereof on days 1, 4, 8 and 11 of a 21-day cycle.

In some embodiments, 0.25-5 mg of the peptidomimetic macrocycle per kilogram body weight of the human subject or a pharmaceutically acceptable salt thereof is administered to the human subject.

In some embodiments, the amount of the peptidomimetic macrocycle entered on day 4, 8, and/or day 11 is greater than the amount of the peptidomimetic macrocycle entered on day 1. In another embodiment, the amount of the peptidomimetic macrocycle entered on day 4, 8, and/or day 11 is equal than the amount of the peptidomimetic macrocycle entered on day 1. In another embodiment, the amount of the peptidomimetic macrocycle entered on day 1, 4, and/or day 8 is greater than the amount of the peptidomimetic macrocycle entered on day 11. In another embodiment, equal amounts of the peptidomimetic macrocycle is administered on days 1, 4, 8, and 151.

In some embodiments, the 21-day cycle is repeated 2 or 3 times.

In some embodiments, the peptidomimetic macrocycle comprises an amino acid sequence which is at least about 60%, at least about 70%, at least about 80%, at least about 90%, or at least about 95% identical to an amino acid sequence in any of Table 3, Table 3a, Table 3b, and Table 3c, where the peptidomimetic macrocycle has the formula:

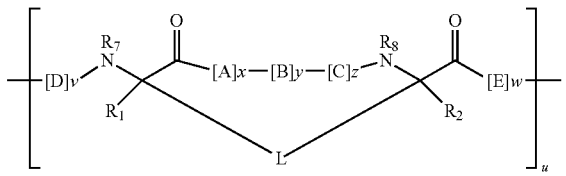

Formula (I)

wherein:

each A, C, and D is independently an amino acid;

each B is independently an amino acid,

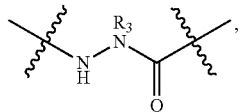

[—NH-$L_3$-CO—], [—NH-$L_3$-$SO_2$—], or [—NH-$L_3$-];

each E is independently an amino acid selected from the group consisting of Ala (alanine), D-Ala (D-alanine), Aib (α-aminoisobutyric acid), Sar (N-methyl glycine), and Ser (serine);

each $R_1$ and $R_2$ is independently —H, alkyl, alkenyl, alkynyl, arylalkyl, cycloalkyl, cycloalkylalkyl, heteroalkyl, or heterocycloalkyl, unsubstituted or substituted with halo-; or forms a macrocycle-forming linker L' connected to the alpha position of one of the D or E amino acids;

each $R_3$ independently is hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with $R_5$;

each L and L' is independently a macrocycle-forming linker of the formula -$L_1$-$L_2$-;

each $L_3$ is independently alkylene, alkenylene, alkynylene, heteroalkylene, cycloalkylene, heterocycloalkylene, cycloarylene, heterocycloarylene, or [—$R_4$—K—$R_4$-]$_n$, each being optionally substituted with $R_5$;

each $R_4$ is independently alkylene, alkenylene, alkynylene, heteroalkylene, cycloalkylene, heterocycloalkylene, arylene, or heteroarylene;

each K is independently O, S, SO, $SO_2$, CO, $CO_2$, or $CONR_3$;

each $R_5$ is independently halogen, alkyl, —$OR_6$, —$N(R_6)_2$, —$SR_6$, —$SOR_6$, —$SO_2R_6$, —$CO_2R_6$, a fluorescent moiety, a radioisotope or a therapeutic agent;

each $R_6$ is independently —H, alkyl, alkenyl, alkynyl, arylalkyl, cycloalkylalkyl, heterocycloalkyl, a fluorescent moiety, a radioisotope or a therapeutic agent;

each $R_7$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with a D residue;

each $R_8$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with an E residue;

each v is independently an integer from 0-1000;

each w is independently an integer from 0-1000, for example, 0-500, 0-200, 0-100, 0-50, 0-30, 0-20, 0-10, 0-5, 1-1000, 1-500, 1-200, 1-100, 1-50, 1-30, 1-20, 1-10, 1-5, 3-1000, 3-500, 3-200, 3-100, 3-50, 3-30, 3-20, 3-10, 0, 1, 2, 3, 4, 5, 6, 7, 8, 9, or 10;

u is an integer from 1-10;

each x, y and z is independently an integer from 0-10; and each n is independently an integer from 1-5.

In some embodiments, the peptidomimetic macrocycle has formula:

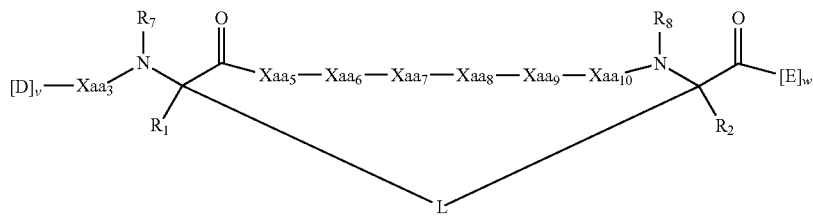

wherein:

each of $Xaa_3$, $Xaa_5$, $Xaa_6$, $Xaa_7$, $Xaa_8$, $Xaa_9$, and $Xaa_{10}$ is individually an amino acid, where at least three of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$His_5$-$Tyr_6$-$Trp_7$-$Ala8$-$Gln_9$-$Leu_{10}$-$X_{11}$-$Ser_{12}$ (SEQ ID NO: 8) or $Phe_3$-$X_4$-$Glu_5$-$Tyr_6$-$Trp_7$-$Ala_8$-$Gln_9$-$Leu_{10}$/$Cba_{10}$-$X_{11}$-$Ala_{12}$ (SEQ ID NO: 9), where each $X_4$ and $X_{11}$ is independently an amino acid;
each D is independently an amino acid;
each E is independently an amino acid selected from the group consisting of Ala (alanine), D-Ala (D-alanine), Aib (α-aminoisobutyric acid), Sar (N-methyl glycine), and Ser (serine); each $R_1$ and $R_2$ are independently —H, alkyl, alkenyl, alkynyl, arylalkyl, cycloalkyl, cycloalkylalkyl, heteroalkyl, or heterocycloalkyl, unsubstituted or substituted with halo-; or forms a macrocycle-forming linker L' connected to the alpha position of one of the D or E amino acids;
each L or L' is independently a macrocycle-forming linker
each $R_5$ is independently halogen, alkyl, —$OR_6$, —$N(R_6)_2$, —$SR_6$, —$SOR_6$, —$SO_2R_6$, —$CO_2R_6$, a fluorescent moiety, a radioisotope or a therapeutic agent;
each $R_6$ is independently —H, alkyl, alkenyl, alkynyl, arylalkyl, cycloalkylalkyl, heterocycloalkyl, a fluorescent moiety, a radioisotope or a therapeutic agent;
each $R_7$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with a D residue;
each $R_8$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with an E residue;
v is an integer from 1-1000; and
w is an integer from 0-1000.

In some embodiments, at least one of the macrocycle-forming linker has a formula-$L_1$-$L_2$-, where $L_1$ and $L_2$ are independently alkylene, alkenylene, alkynylene, heteroalkylene, cycloalkylene, heterocycloalkylene, cycloarylene, heterocycloarylene, or [—$R_4$—K—$R_4$-]$_n$, each being optionally substituted with $R_5$; each $R_4$ is independently alkylene, alkenylene, alkynylene, heteroalkylene, cycloalkylene, heterocycloalkylene, arylene, or heteroarylene; each K is independently O, S, SO, $SO_2$, CO, $CO_2$, or $CONR_3$; each $R_3$ is independently hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with $R_5$; and n is an integer from 1-5.

In some embodiments, w is an integer from 0-1000, for example, 0-500, 0-200, 0-100, 0-50, 0-30, 0-20, 0-10, 0-5, 1-1000, 1-500, 1-200, 1-100, 1-50, 1-30, 1-20, 1-10, 1-5, 3-1000, 3-500, 3-200, 3-100, 3-50, 3-30, 3-20, 3-10, 0, 1, 2, 3, 4, 5, 6, 7, 8, 9, or 10.

In some embodiments, $Xaa_5$ is Glu or an amino acid analog thereof. In another embodiment, each E is independently Ala (alanine), Ser (serine) or an analog thereof. In another embodiment, [D]$_v$ is-$Leu_1$-$Thr_2$.

In some embodiments, w is 3-10. In another embodiment, w is 3-6. In another embodiment, w is 6-10. In another embodiment, w is 6.

In some embodiments, v is 1-10. In another embodiment, v is 2-10. In another embodiment, v is 2-5. In another embodiment, v is 2.

In some embodiments, $L_1$ and $L_2$ are independently alkylene, alkenylene, alkynylene, heteroalkylene, cycloalkylene, heterocycloalkylene, cycloarylene, or heterocycloarylene, each being optionally substituted with $R_5$. In another embodiment, $L_1$ and $L_2$ are independently alkylene or alkenylene. In another embodiment, L is alkylene, alkenylene, or alkynylene. In another embodiment, L is alkylene. In another embodiment, L is $C_3$-$C_{16}$ alkylene. In another embodiment, L is $C_{10}$-$C_{14}$ alkylene.

In some embodiments, $R_1$ and $R_2$ are independently —H, alkyl, alkenyl, alkynyl, arylalkyl, cycloalkyl, cycloalkylalkyl, heteroalkyl, or heterocycloalkyl, unsubstituted or substituted with halo-. In another embodiment, $R_1$ and $R_2$ are H. In another embodiment, $R_1$ and $R_2$ are independently alkyl. In another embodiment, $R_1$ and $R_2$ are methyl.

In some embodiments, x+y+z=6.

In some embodiments, u is 1.

In some embodiments, the peptidomimetic macrocycle comprises at least one amino acid which is an amino acid analog.

In some embodiments, the peptidomimetic macrocycle has formula (SEQ ID NO: 163):

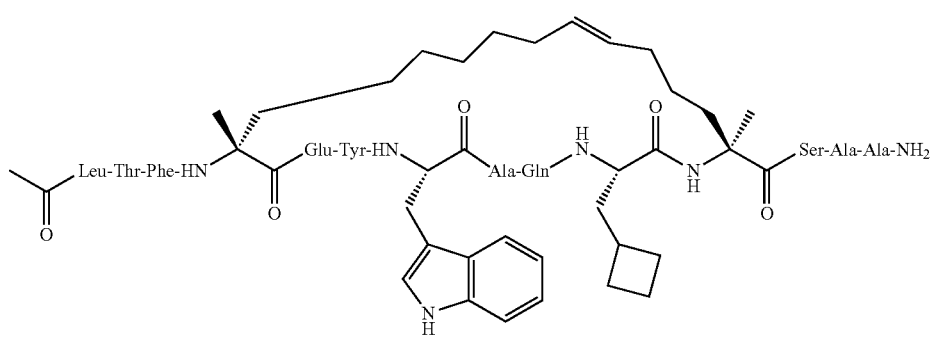

or a pharmaceutically acceptable salt thereof.

In some embodiments, the peptidomimetic macrocycle has formula (SEQ ID NO: 124):

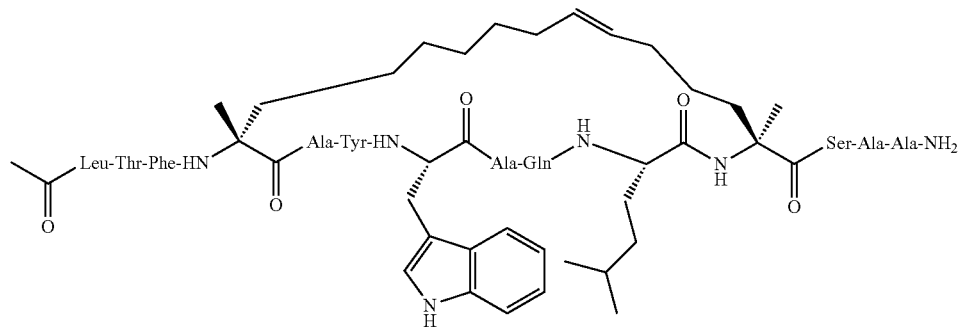

or a pharmaceutically acceptable salt thereof.

In some embodiments, the peptidomimetic macrocycle has formula (SEQ ID NO: 123):

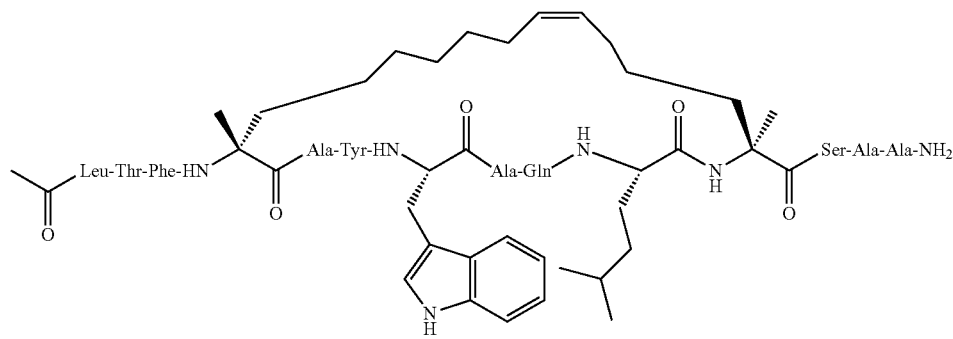

or a pharmaceutically acceptable salt thereof.

In some embodiments, the peptidomimetic macrocycle has formula (SEQ ID NO: 108):

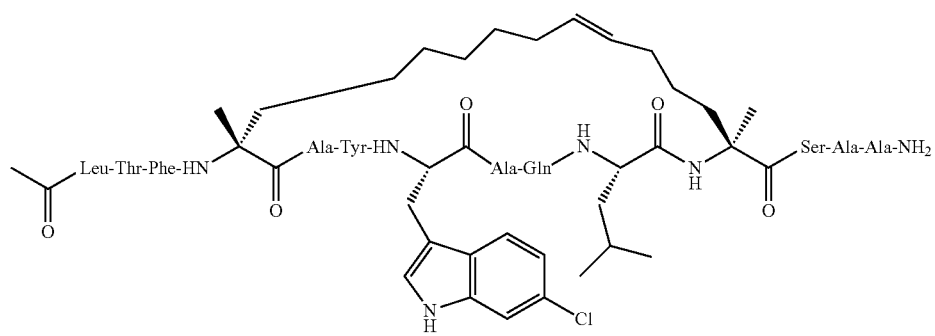

or a pharmaceutically acceptable salt thereof.

In some embodiments, the peptidomimetic macrocycle has formula (SEQ ID NO: 397):

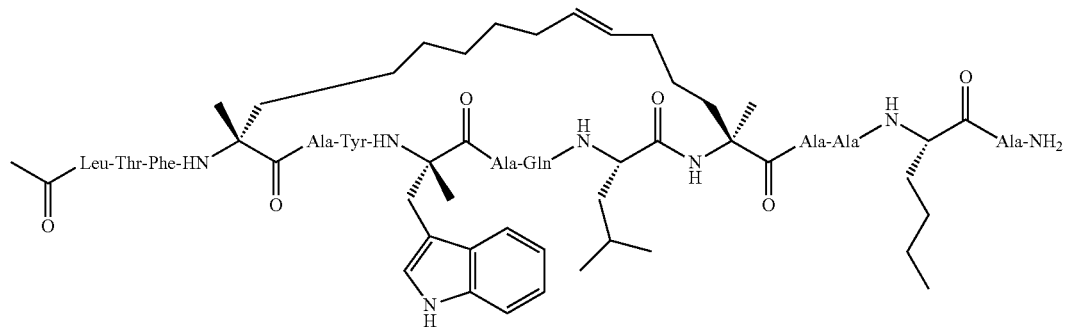

or a pharmaceutically acceptable salt thereof.

In some embodiments, the peptidomimetic macrocycle has formula (SEQ ID NO: 340):

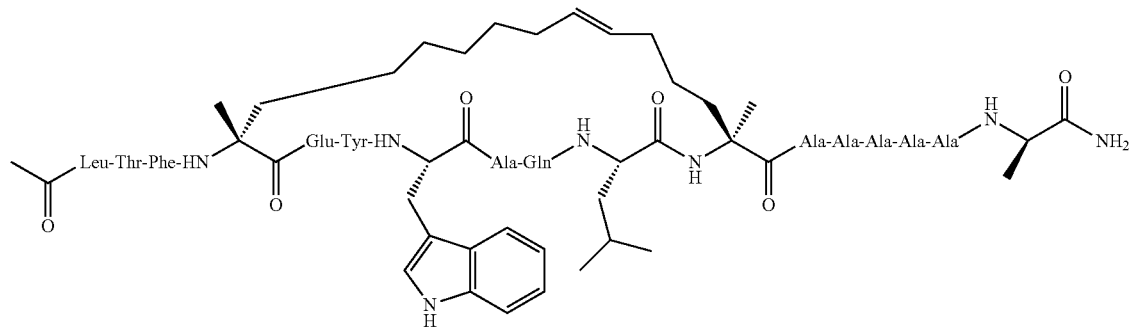

or a pharmaceutically acceptable salt thereof.

In some embodiments, the peptidomimetic macrocycle has formula (SEQ ID NO: 454):

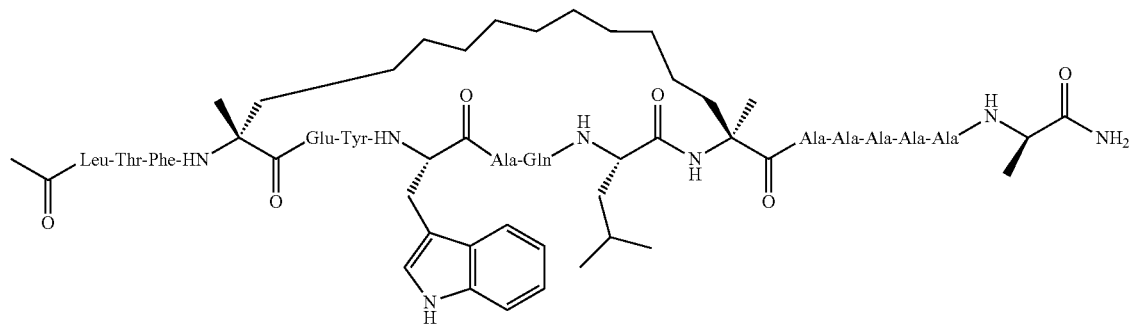

or a pharmaceutically acceptable salt thereof.

In some embodiments, the peptidomimetic macrocycle has formula (SEQ ID NO: 360):

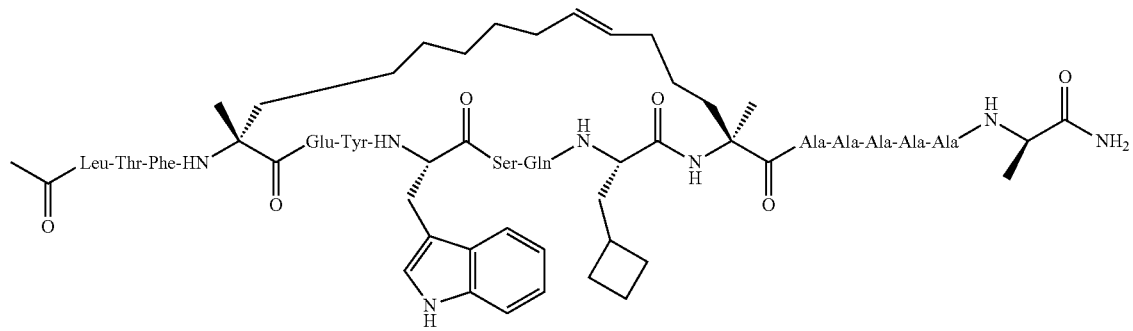

or a pharmaceutically acceptable salt thereof.

In some embodiments, the peptidomimetic macrocycle has formula (SEQ ID NO: 80)

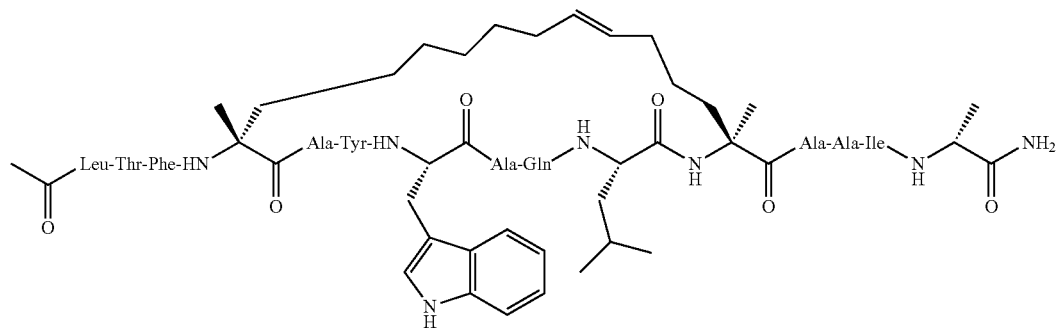

or a pharmaceutically acceptable salt thereof.

In some embodiments, the peptidomimetic macrocycle has formula (SEQ ID NO: 78):

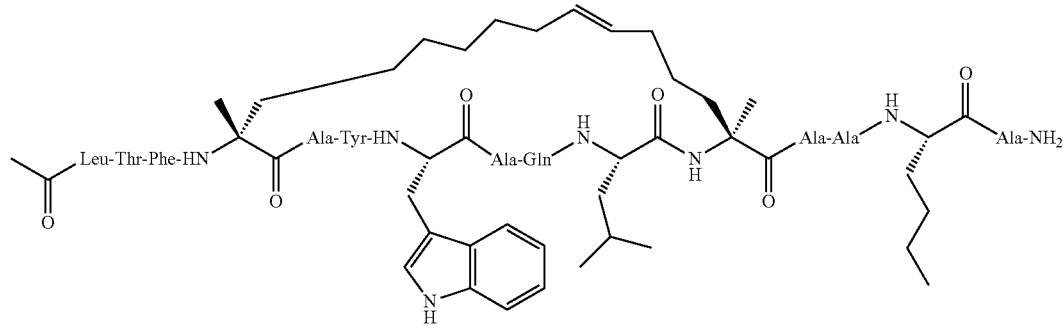

or a pharmaceutically acceptable salt thereof.

In some embodiments, the peptidomimetic macrocycle has formula (SEQ ID NO: 16):

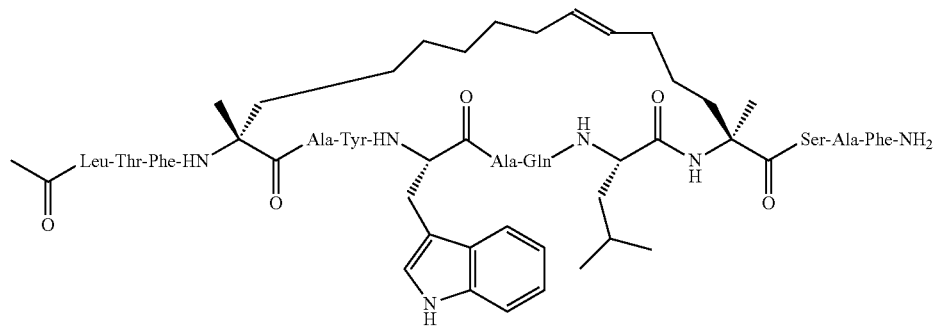

or a pharmaceutically acceptable salt thereof.

In some embodiments, the peptidomimetic macrocycle has formula (SEQ ID NO: 169):

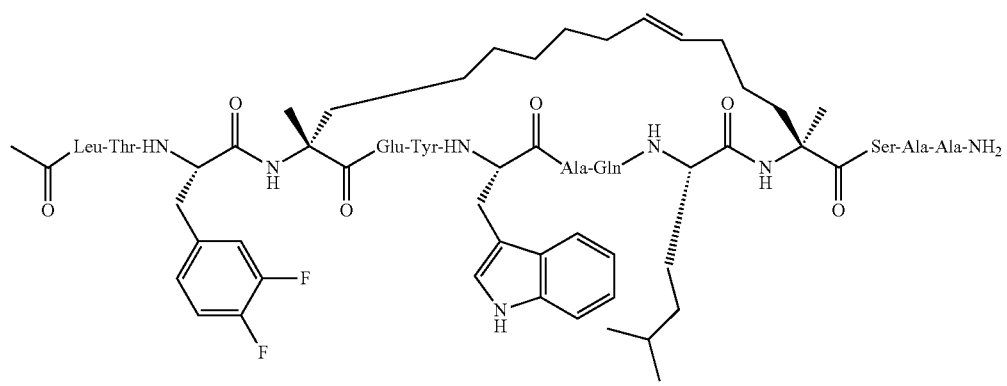

or a pharmaceutically acceptable salt thereof.

In some embodiments, the peptidomimetic macrocycle has formula (SEQ ID NO: 324):

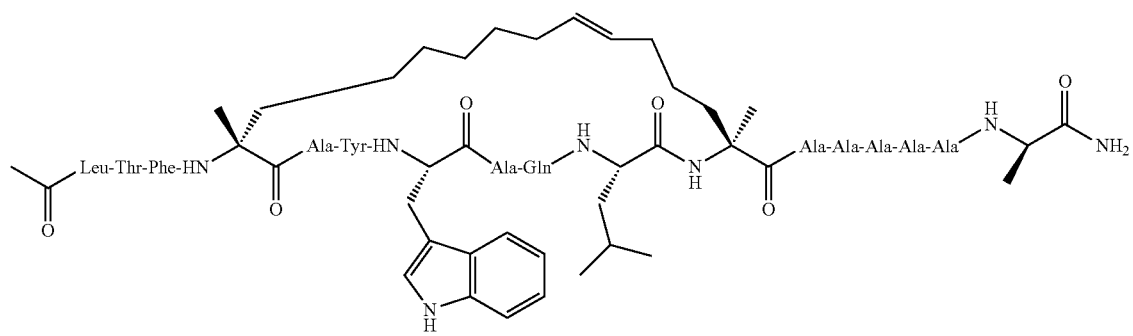

or a pharmaceutically acceptable salt thereof.

In some embodiments, the peptidomimetic macrocycle has formula (SEQ ID NO: 258):

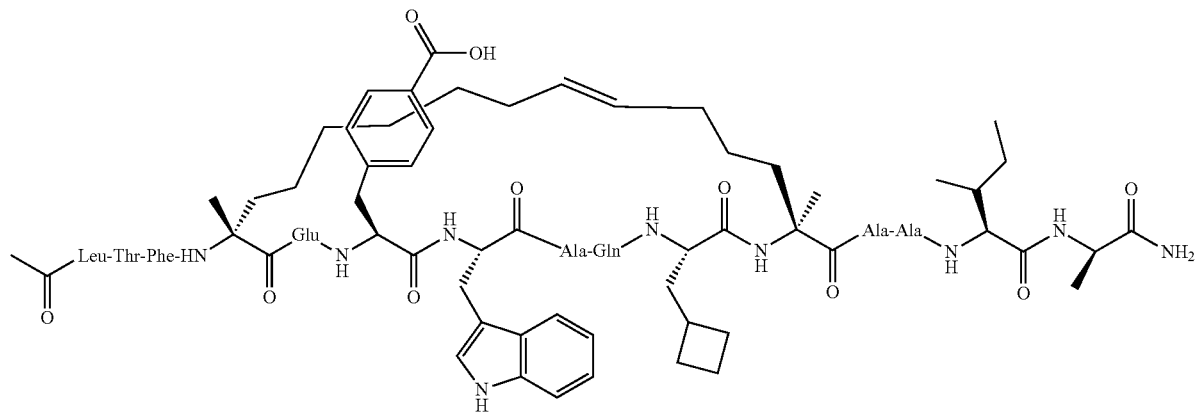

or a pharmaceutically acceptable salt thereof.

In some embodiments, the peptidomimetic macrocycle has formula (SEQ ID NO: 446):

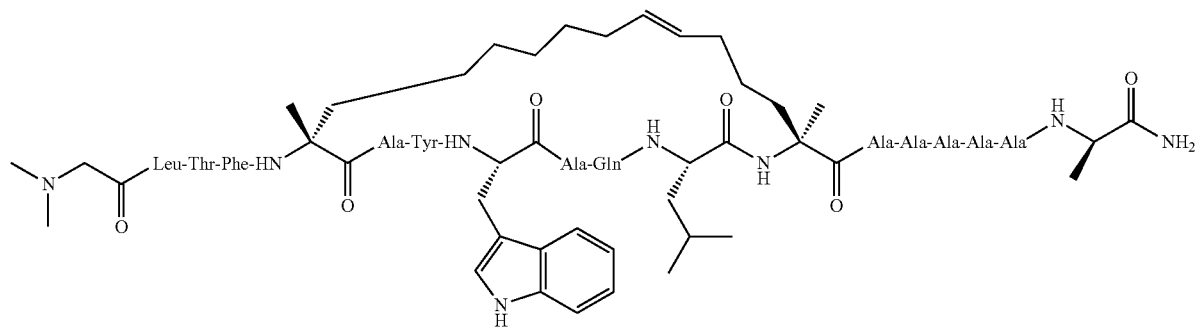

or a pharmaceutically acceptable salt thereof.

In some embodiments, the peptidomimetic macrocycle has formula (SEQ ID NO: 358):

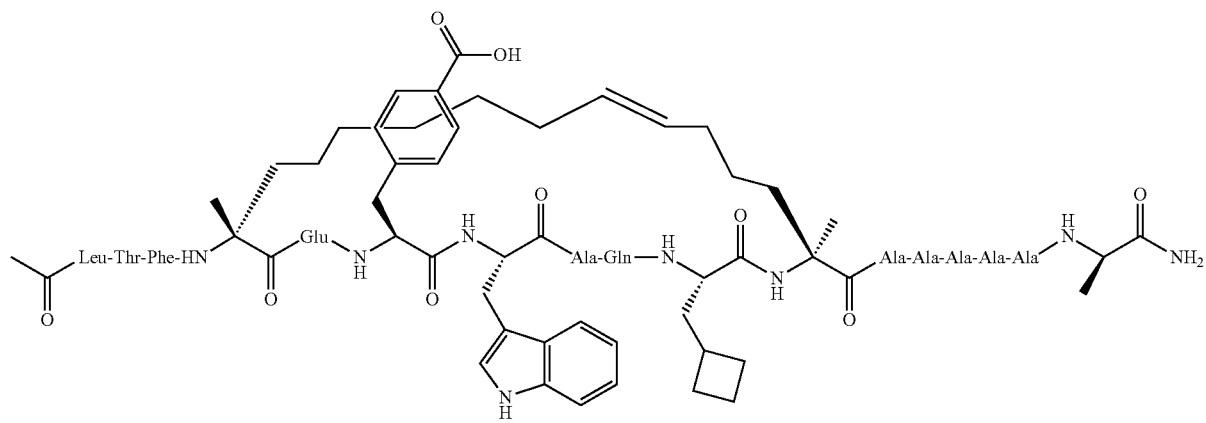

or a pharmaceutically acceptable salt thereof.

In some embodiments, the peptidomimetic macrocycle has formula (SEQ ID NO: 464):

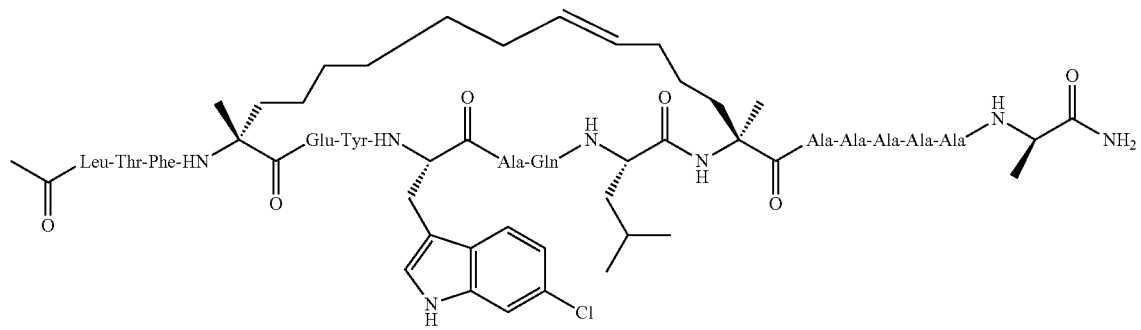

or a pharmaceutically acceptable salt thereof.

In some embodiments, the peptidomimetic macrocycle has formula (SEQ ID NO: 466):

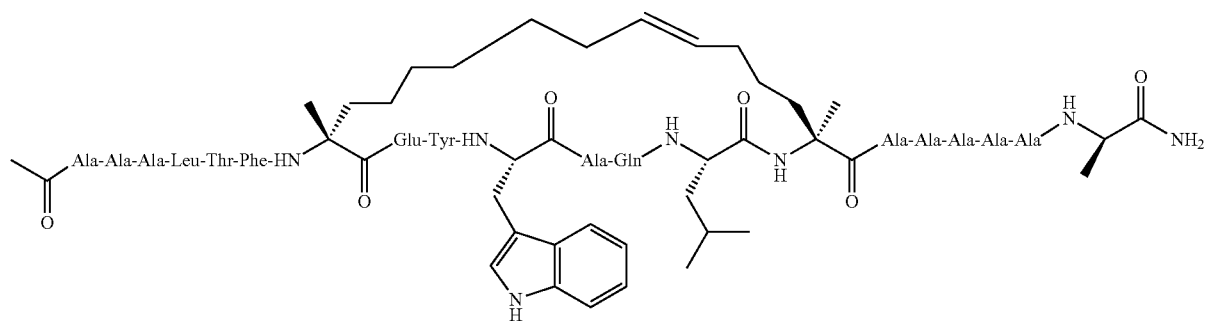

or a pharmaceutically acceptable salt thereof.

In some embodiments, the peptidomimetic macrocycle has formula (SEQ ID NO: 467):

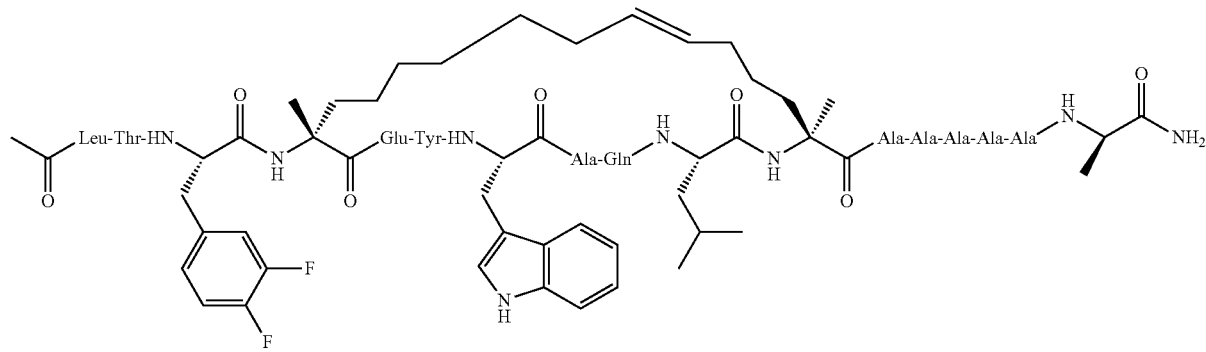

or a pharmaceutically acceptable salt thereof.

In some embodiments, the peptidomimetic macrocycle has formula (SEQ ID NO: 376):

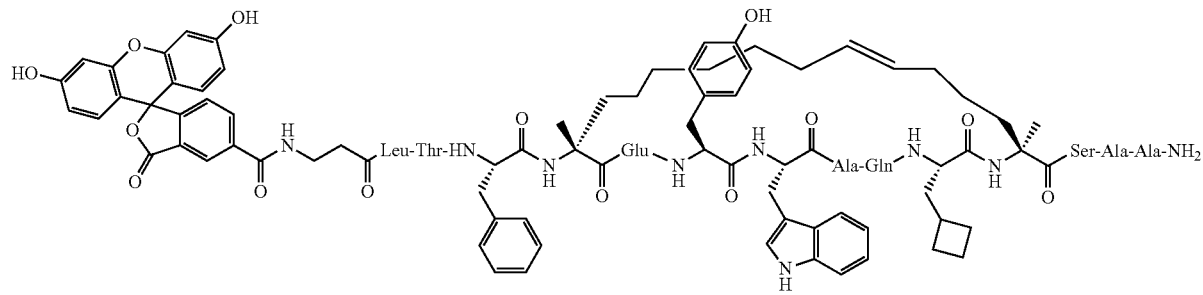

or a pharmaceutically acceptable salt thereof.

In some embodiments, the peptidomimetic macrocycle has formula (SEQ ID NO: 471):

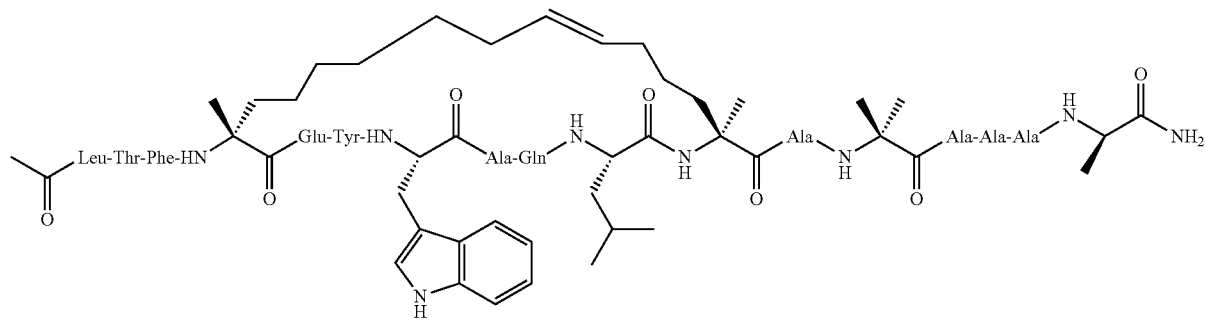

or a pharmaceutically acceptable salt thereof.

In some embodiments, the peptidomimetic macrocycle has formula: (SEQ ID NO: 473)

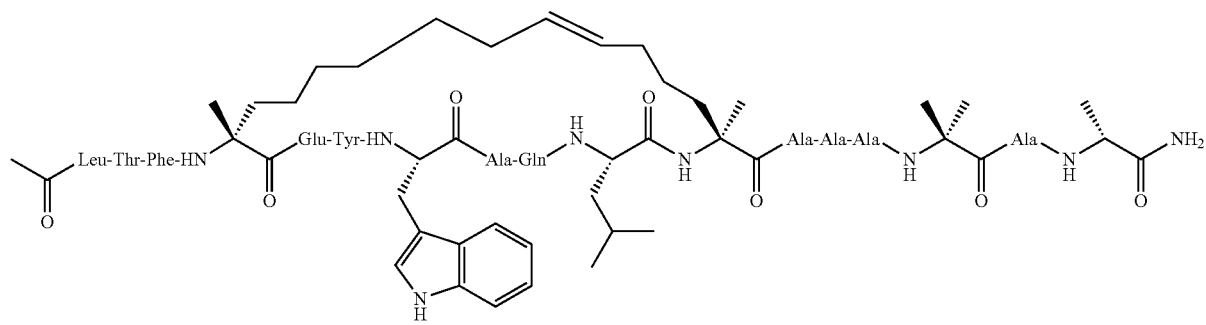

or a pharmaceutically acceptable salt thereof.

In some embodiments, the peptidomimetic macrocycle has formula (SEQ ID NO: 475):

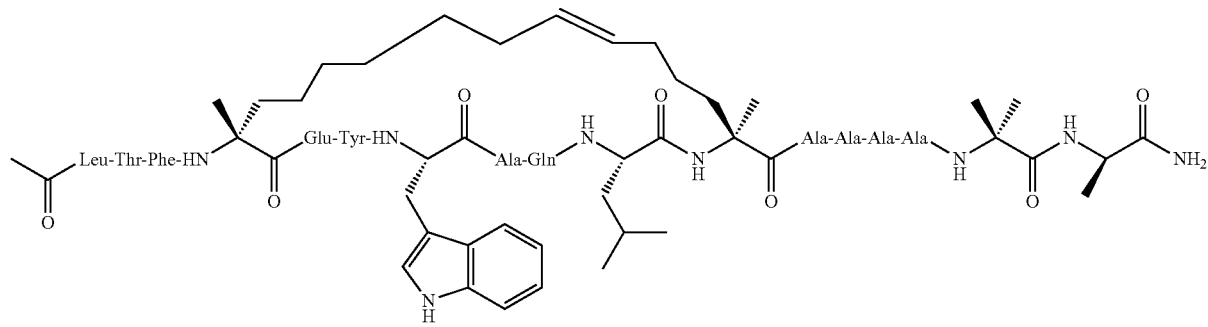

or a pharmaceutically acceptable salt thereof.

In some embodiments, the peptidomimetic macrocycle has formula (SEQ ID NO: 476):

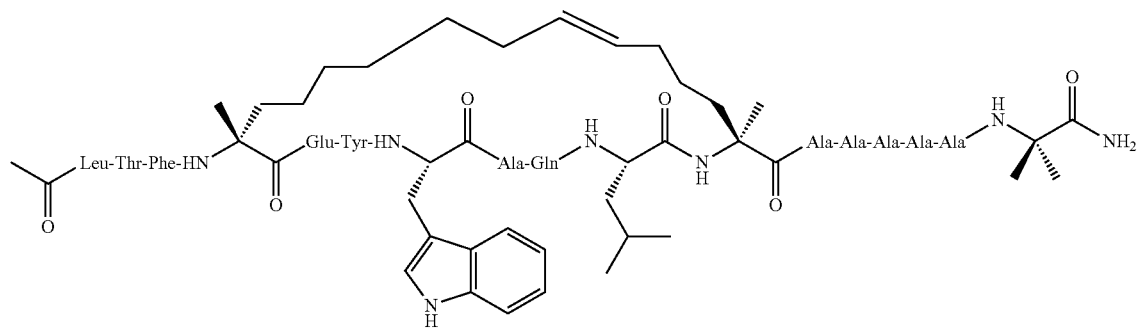

or a pharmaceutically acceptable salt thereof.

In some embodiments, the peptidomimetic macrocycle has formula (SEQ ID NO: 481):

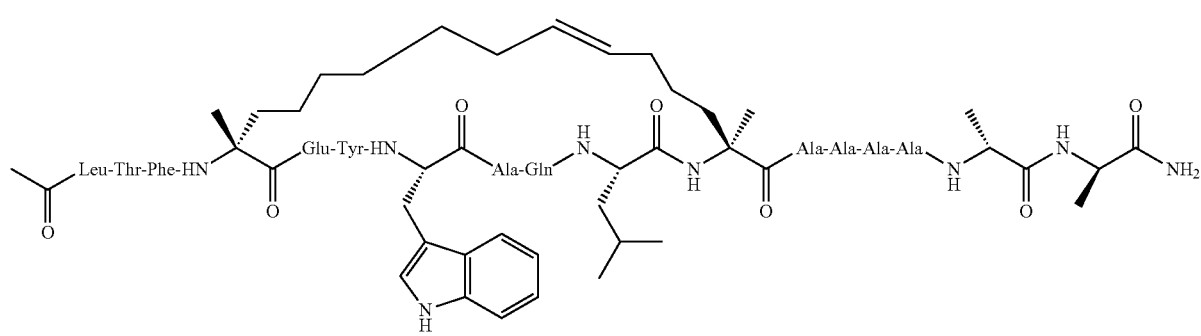

or a pharmaceutically acceptable salt thereof.

In some embodiments, the peptidomimetic macrocycle has formula (SEQ ID NO: 482):

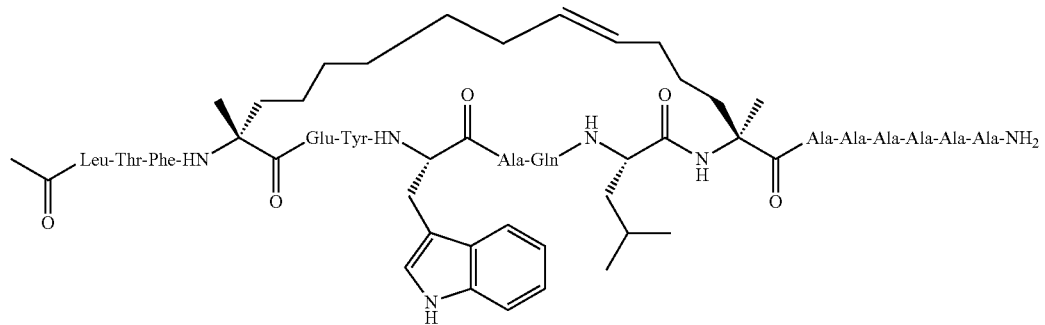

or a pharmaceutically acceptable salt thereof.

In some embodiments, the peptidomimetic macrocycle has formula (SEQ ID NO: 487):

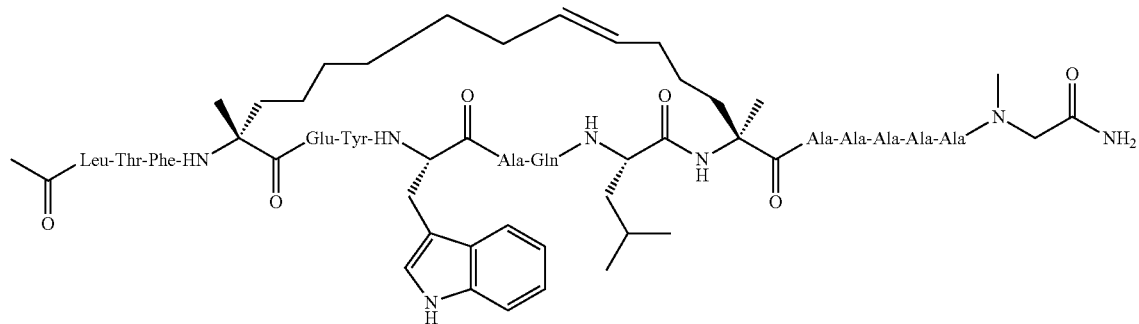

or a pharmaceutically acceptable salt thereof.

In some embodiments, the peptidomimetic macrocycle has formula (SEQ ID NO: 572):

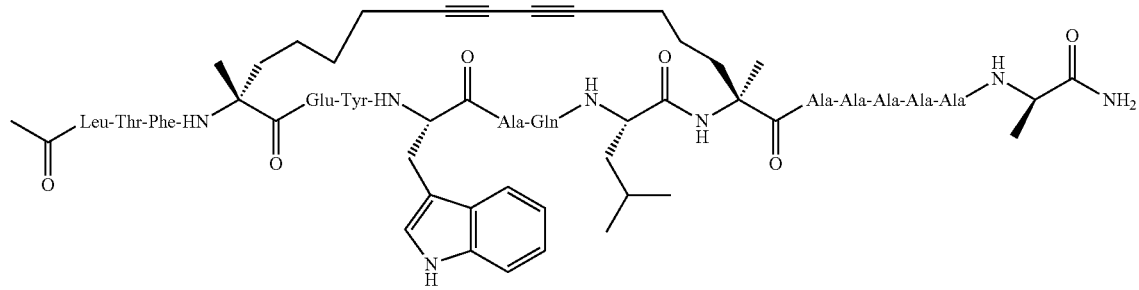

or a pharmaceutically acceptable salt thereof.

In some embodiments, the peptidomimetic macrocycle has formula (SEQ ID NO: 572):

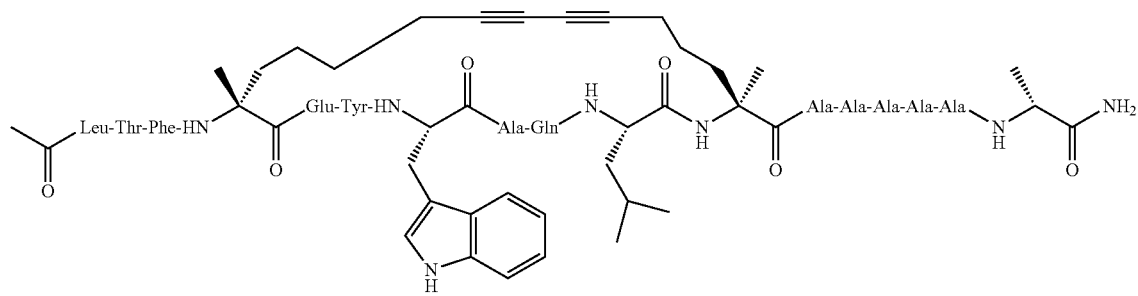

or a pharmaceutically acceptable salt thereof.

In some embodiments, the peptidomimetic macrocycle has formula (SEQ ID NO: 1500):

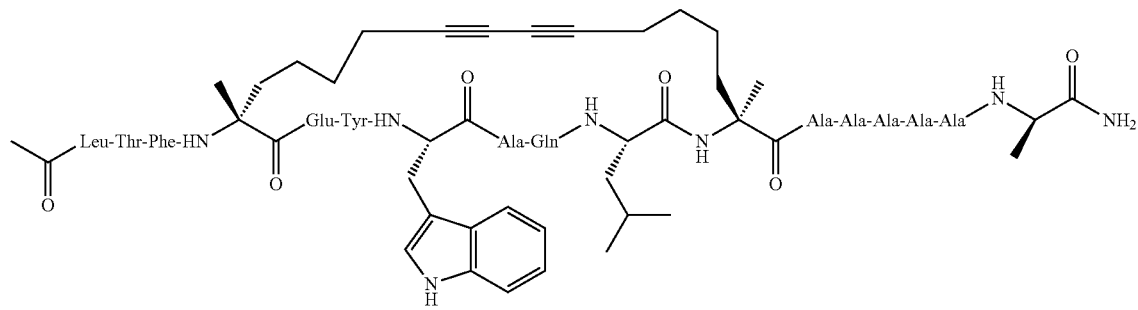

or a pharmaceutically acceptable salt thereof.

Also disclosed herein are methods of identifying one or more liquid cancer biomarkers in a human subject lacking a p53 deactivating mutation, comprising administering to the human subject a therapeutically effective amount of a peptidomimetic macrocycle.

In some embodiments, the biomarkers are p53 status, MDM2 expression level or MDMX expression level.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The novel features of the invention are set forth with particularity in the appended claims.

A better understanding of the features and advantages of the present invention will be obtained by reference to the following detailed description that sets forth illustrative embodiments, in which the principles of the invention are utilized, and the accompanying drawings of which:

FIG. 1 shows human wild type P53 coding and protein sequence (SEQ ID NO: 1501).

DETAILED DESCRIPTION OF THE INVENTION

Figure 2:
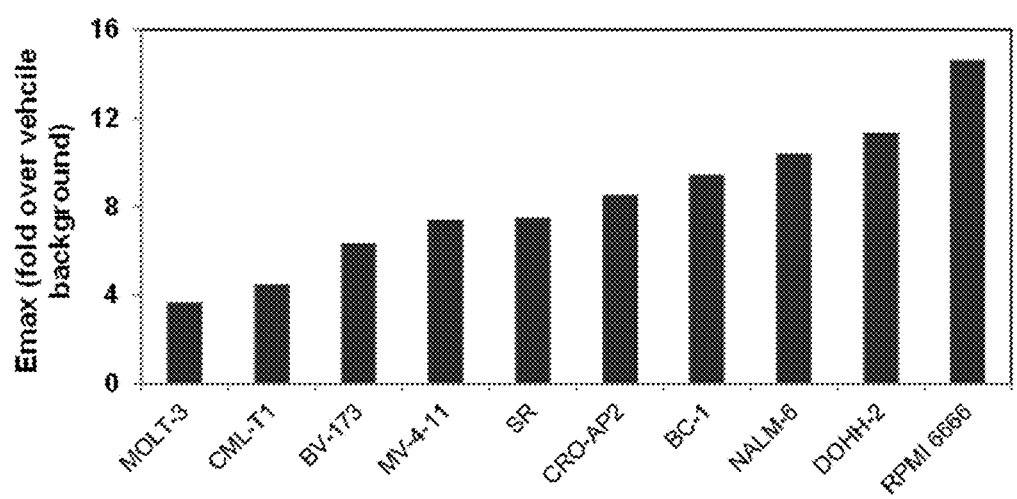
FIG. 2 shows peptide 1 yielded robust apoptotic responses in p53 wild-type hematopoietic cell lines.

While preferred embodiments of the present disclosure have been shown and described herein, it will be obvious to those skilled in the art that such embodiments are provided by way of example only. Numerous variations, changes, and substitutions will now occur to those skilled in the art without departing from the disclosure. It should be understood that various alternatives to the embodiments of the disclosure described herein can be employed in practicing the disclosure. It is intended that the following claims define the scope of the disclosure and that methods and structures within the scope of these claims and their equivalents be covered thereby.

Definitions

As used herein, the term "macrocycle" refers to a molecule having a chemical structure including a ring or cycle formed by at least 9 covalently bonded atoms.

As used herein, the term "peptidomimetic macrocycle" or "crosslinked polypeptide" refers to a compound comprising a plurality of amino acid residues joined by a plurality of peptide bonds and at least one macrocycle-forming linker which forms a macrocycle between a first naturally-occurring or non-naturally-occurring amino acid residue (or analog) and a second naturally-occurring or non-naturallyoccurring amino acid residue (or analog) within the same molecule. Peptidomimetic macrocycle include embodiments where the macrocycle-forming linker connects the a carbon of the first amino acid residue (or analog) to the a carbon of the second amino acid residue (or analog). The peptidomimetic macrocycles optionally include one or more non-peptide bonds between one or more amino acid residues and/or amino acid analog residues, and optionally include one or more non-naturally-occurring amino acid residues or amino acid analog residues in addition to any which form the macrocycle. A "corresponding uncrosslinked polypeptide" when referred to in the context of a peptidomimetic macrocycle is understood to relate to a polypeptide of the same length as the macrocycle and comprising the equivalent natural amino acids of the wild-type sequence corresponding to the macrocycle.

As used herein, the term "laboratory TLS" refers to a 25% increase in the levels of serum uric acid, potassium, or phosphorus or a 25% decrease in calcium levels.

As used herein, the term "helical stability" refers to the maintenance of a helical structure by a peptidomimetic macrocycle as measured by circular dichroism or NMR. For example, in some embodiments, a peptidomimetic macrocycle exhibits at least a 1.25, 1.5, 1.75 or 2-fold increase in α-helicity as determined by circular dichroism compared to a corresponding uncrosslinked macrocycle.

The term "amino acid" refers to a molecule containing both an amino group and a carboxyl group. Suitable amino acids include, without limitation, both the D- and L-isomers of the naturally-occurring amino acids, as well as non-naturally occurring amino acids prepared by organic synthesis or other metabolic routes. The term amino acid, as used herein, includes, without limitation, α-amino acids, natural amino acids, non-natural amino acids, and amino acid analogs.

The term "α-amino acid" refers to a molecule containing both an amino group and a carboxyl group bound to a carbon which is designated the α-carbon.

The term "β-amino acid" refers to a molecule containing both an amino group and a carboxyl group in a β configuration.

The term "naturally occurring amino acid" refers to any one of the twenty amino acids commonly found in peptides synthesized in nature, and known by the one letter abbreviations A, R, N, C, D, Q, E, G, H, I, L, K, M, F, P, S, T, W, Y and V.

The following table shows a summary of the properties of natural amino acids:

| Amino Acid | 3-Letter Code | 1-Letter Code | Side-chain Polarity | Side-chain charge (pH 7.4) | Hydropathy Index |
|---|---|---|---|---|---|
| Alanine | Ala | A | nonpolar | neutral | 1.8 |
| Arginine | Arg | R | polar | positive | −4.5 |
| Asparagine | Asn | N | polar | neutral | −3.5 |
| Aspartic acid | Asp | D | polar | negative | −3.5 |
| Cysteine | Cys | C | polar | neutral | 2.5 |
| Glutamic acid | Glu | E | polar | negative | −3.5 |
| Glutamine | Gln | Q | polar | neutral | −3.5 |
| Glycine | Gly | G | nonpolar | neutral | −0.4 |
| Histidine | His | H | polar | positive (10%) neutral (90%) | −3.2 |
| Isoleucine | Ile | I | nonpolar | neutral | 4.5 |
| Leucine | Leu | L | nonpolar | neutral | 3.8 |
| Lysine | Lys | K | polar | positive | −3.9 |
| Methionine | Met | M | nonpolar | neutral | 1.9 |
| Phenylalanine | Phe | F | nonpolar | neutral | 2.8 |
| Proline | Pro | P | nonpolar | neutral | −1.6 |
| Serine | Ser | S | polar | neutral | −0.8 |
| Threonine | Thr | T | polar | neutral | −0.7 |
| Tryptophan | Trp | W | nonpolar | neutral | −0.9 |
| Tyrosine | Tyr | Y | polar | neutral | −1.3 |
| Valine | Val | V | nonpolar | neutral | 4.2 |

"Hydrophobic amino acids" include small hydrophobic amino acids and large hydrophobic amino acids. "Small hydrophobic amino acid" are glycine, alanine, proline, and analogs thereof. "Large hydrophobic amino acids" are valine, leucine, isoleucine, phenylalanine, methionine, tryptophan, and analogs thereof. "Polar amino acids" are serine, threonine, asparagine, glutamine, cysteine, tyrosine, and analogs thereof. "Charged amino acids" are lysine, arginine, histidine, aspartate, glutamate, and analogs thereof.

The term "amino acid analog" refers to a molecule which is structurally similar to an amino acid and which can be substituted for an amino acid in the formation of a peptidomimetic macrocycle. Amino acid analogs include, without limitation, β-amino acids and amino acids where the amino or carboxy group is substituted by a similarly reactive group (e.g., substitution of the primary amine with a secondary or tertiary amine, or substitution of the carboxy group with an ester).

The term "non-natural amino acid" refers to an amino acid which is not one of the twenty amino acids commonly found in peptides synthesized in nature, and known by the one letter abbreviations A, R, N, C, D, Q, E, G, H, I, L, K, M, F, P, S, T, W, Y and V. Non-natural amino acids or amino acid analogs include, without limitation, structures according to the following:

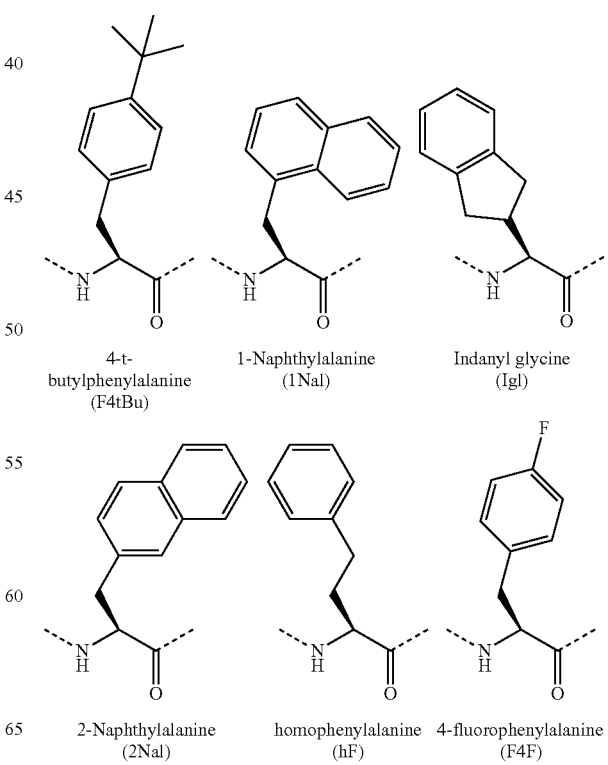

4-t-butylphenylalanine (F4tBu)  1-Naphthylalanine (1Nal)  Indanyl glycine (Igl)

2-Naphthylalanine (2Nal)  homophenylalanine (hF)  4-fluorophenylalanine (F4F)

-continued
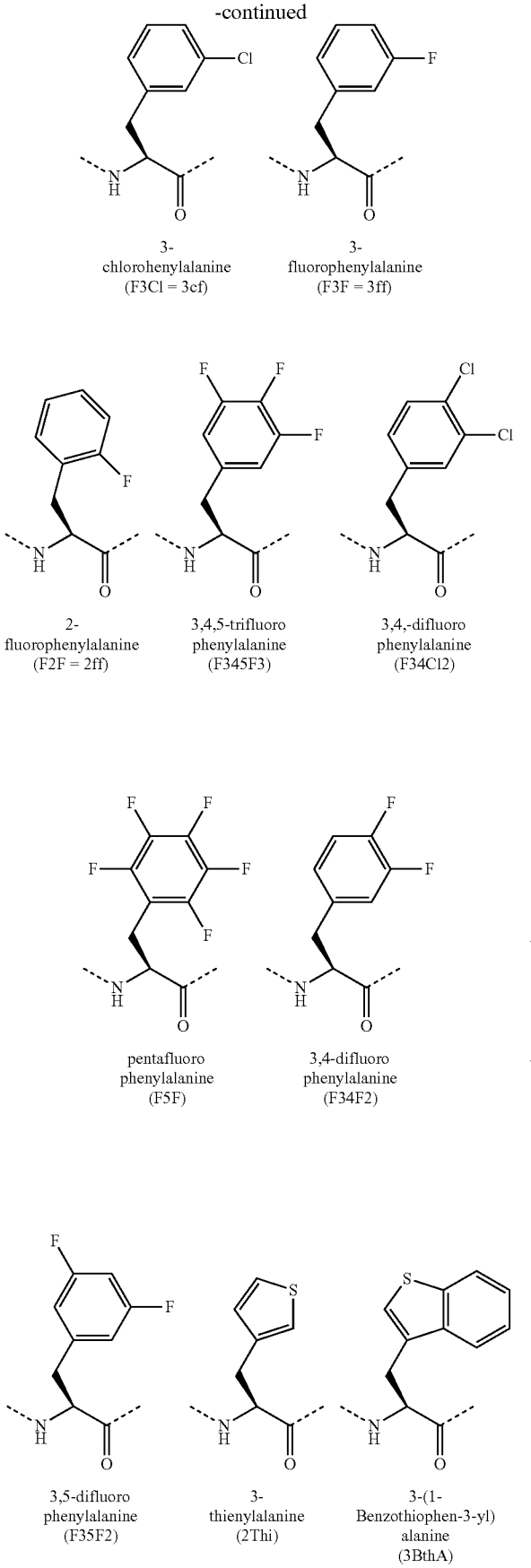
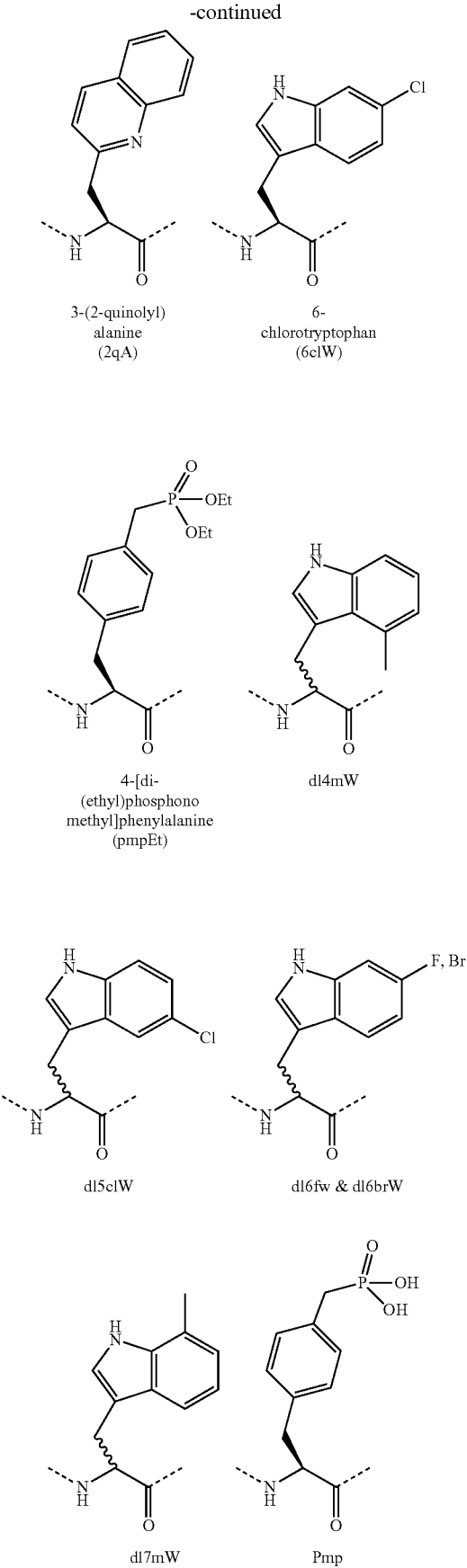

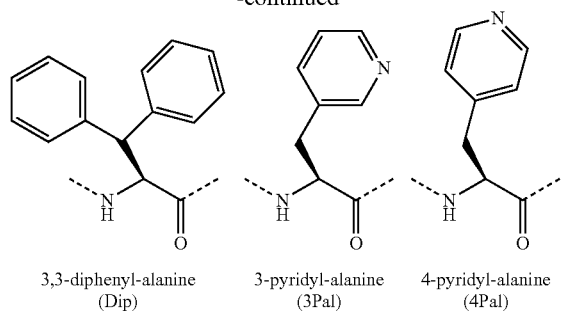
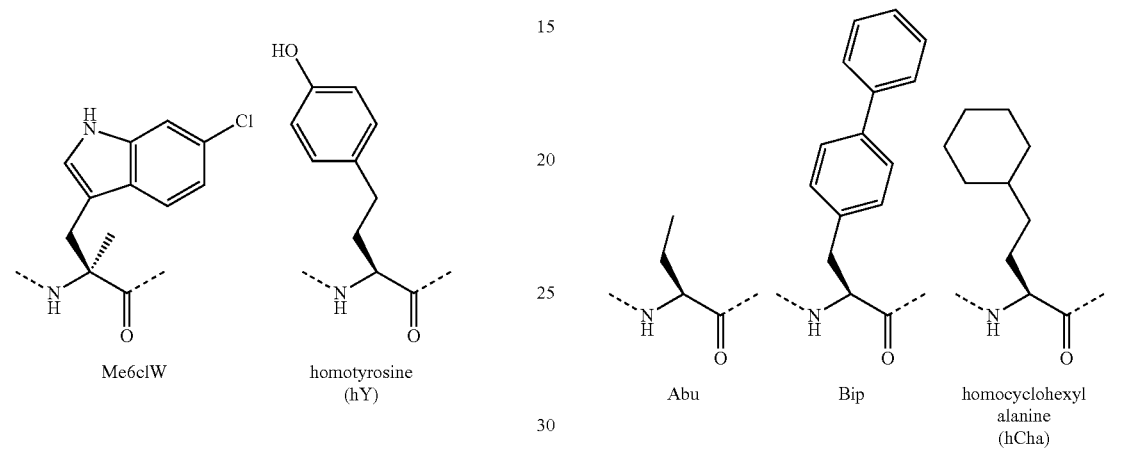
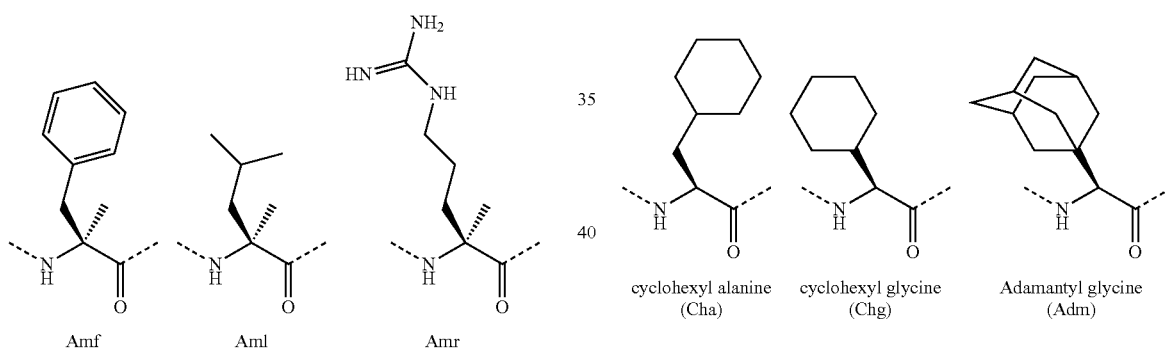
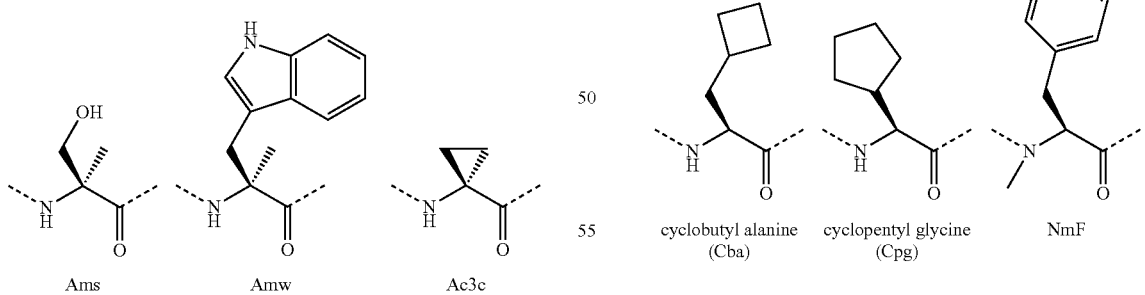
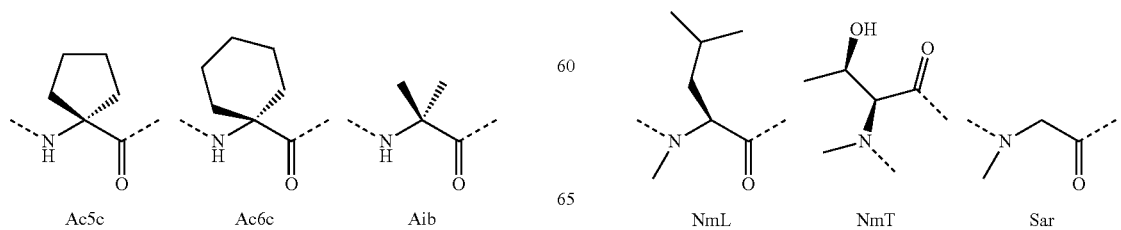

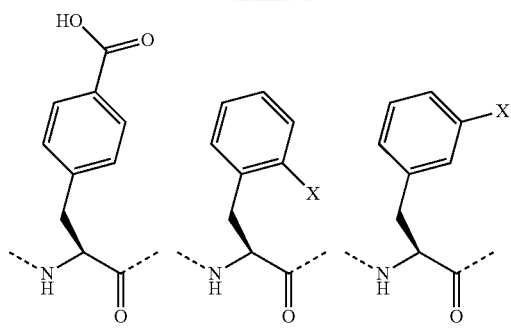
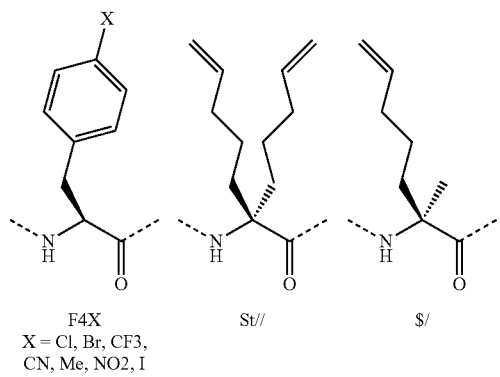
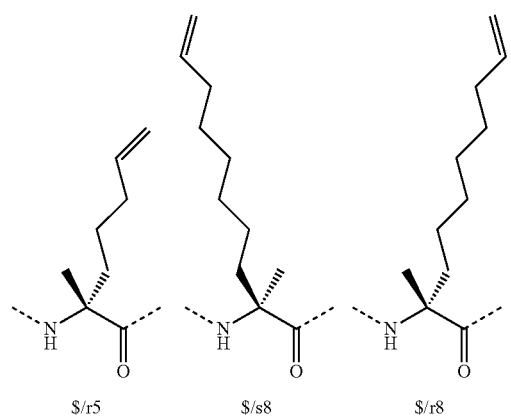
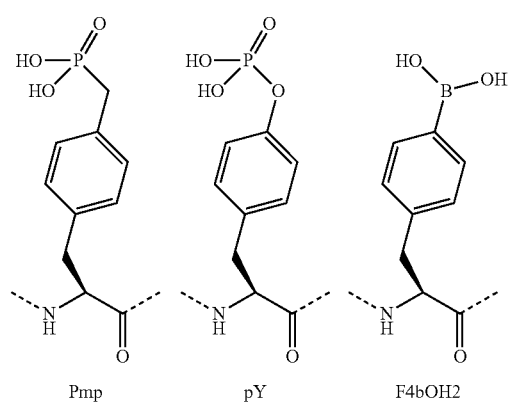
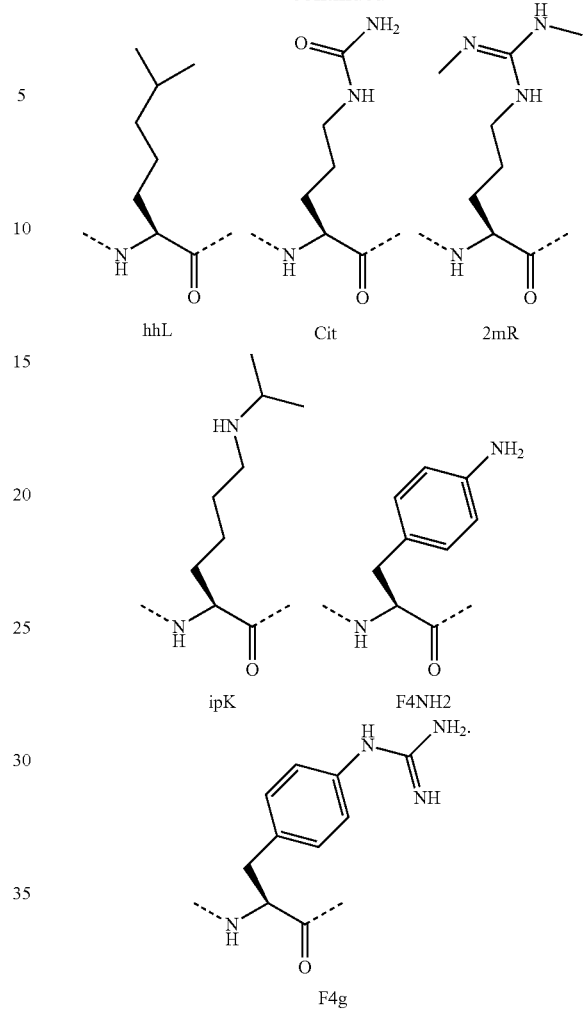

Amino acid analogs include β-amino acid analogs. Examples of β-amino acid analogs include, but are not limited to, the following: cyclic β-amino acid analogs; β-alanine; (R)-β-phenylalanine; (R)-1,2,3,4-tetrahydro-isoquinoline-3-acetic acid; (R)-3-amino-4-(1-naphthyl)-butyric acid; (R)-3-amino-4-(2,4-dichlorophenyl)butyric acid; (R)-3-amino-4-(2-chlorophenyl)-butyric acid; (R)-3-amino-4-(2-cyanophenyl)-butyric acid; (R)-3-amino-4-(2-fluorophenyl)-butyric acid; (R)-3-amino-4-(2-furyl)-butyric acid; (R)-3-amino-4-(2-methylphenyl)-butyric acid; (R)-3-amino-4-(2-naphthyl)-butyric acid; (R)-3-amino-4-(2-thienyl)-butyric acid; (R)-3-amino-4-(2-trifluoromethylphenyl)-butyric acid; (R)-3-amino-4-(3,4-dichlorophenyl)butyric acid; (R)-3-amino-4-(3,4-difluorophenyl)butyric acid; (R)-3-amino-4-(3-benzothienyl)-butyric acid; (R)-3-amino-4-(3-chlorophenyl)-butyric acid; (R)-3-amino-4-(3-cyanophenyl)-butyric acid; (R)-3-amino-4-(3-fluorophenyl)-butyric acid; (R)-3-amino-4-(3-methylphenyl)-butyric acid; (R)-3-amino-4-(3-pyridyl)-butyric acid; (R)-3-amino-4-(3-thienyl)-butyric acid; (R)-3-amino-4-(3-trifluoromethylphenyl)-butyric acid; (R)-3-amino-4-(4-bromophenyl)-butyric acid; (R)-3-amino-4-(4-chlorophenyl)-butyric acid; (R)-3-amino-4-(4-cyanophenyl)-butyric acid; (R)-3-amino-4-(4-fluorophenyl)-butyric acid; (R)-3-amino-4-(4-iodophenyl)-butyric acid; (R)-3-amino-4-(4-methylphenyl)-butyric acid; (R)-3-amino-4-(4-nitrophenyl)-butyric acid; (R)-3-amino-4-(4- pyridyl)-butyric acid; (R)-3-amino-4-(4-trifluoromethylphenyl)-butyric acid; (R)-3-amino-4-pentafluoro-phenylbutyric acid; (R)-3-amino-5-hexenoic acid; (R)-3-amino-5-hexynoic acid; (R)-3-amino-5-phenylpentanoic acid; (R)-3-amino-6-phenyl-5-hexenoic acid; (S)-1,2,3,4-tetrahydro-isoquinoline-3-acetic acid; (S)-3-amino-4-(1-naphthyl)-butyric acid; (S)-3-amino-4-(2,4-dichlorophenyl)butyric acid; (S)-3-amino-4-(2-chlorophenyl)-butyric acid; (S)-3-amino-4-(2-cyanophenyl)-butyric acid; (S)-3-amino-4-(2-fluorophenyl)-butyric acid; (S)-3-amino-4-(2-furyl)-butyric acid; (S)-3-amino-4-(2-methylphenyl)-butyric acid; (S)-3-amino-4-(2-naphthyl)-butyric acid; (S)-3-amino-4-(2-thienyl)-butyric acid; (S)-3-amino-4-(2-trifluoromethylphenyl)-butyric acid; (S)-3-amino-4-(3,4-dichlorophenyl)butyric acid; (S)-3-amino-4-(3,4-difluorophenyl)butyric acid; (S)-3-amino-4-(3-benzothienyl)-butyric acid; (S)-3-amino-4-(3-chlorophenyl)-butyric acid; (S)-3-amino-4-(3-cyanophenyl)-butyric acid; (S)-3-amino-4-(3-fluorophenyl)-butyric acid; (S)-3-amino-4-(3-methylphenyl)-butyric acid; (S)-3-amino-4-(3-pyridyl)-butyric acid; (S)-3-amino-4-(3-thienyl)-butyric acid; (S)-3-amino-4-(3-trifluoromethylphenyl)-butyric acid; (S)-3-amino-4-(4-bromophenyl)-butyric acid; (S)-3-amino-4-(4-chlorophenyl)-butyric acid; (S)-3-amino-4-(4-cyanophenyl)-butyric acid; (S)-3-amino-4-(4-fluorophenyl)-butyric acid; (S)-3-amino-4-(4-iodophenyl)-butyric acid; (S)-3-amino-4-(4-methylphenyl)-butyric acid; (S)-3-amino-4-(4-nitrophenyl)-butyric acid; (S)-3-amino-4-(4-pyridyl)-butyric acid; (S)-3-amino-4-(4-trifluoromethylphenyl)-butyric acid; (S)-3-amino-4-pentafluoro-phenylbutyric acid; (S)-3-amino-5-hexenoic acid; (S)-3-amino-5-hexynoic acid; (S)-3-amino-5-phenylpentanoic acid; (S)-3-amino-6-phenyl-5-hexenoic acid; 1,2,5,6-tetrahydropyridine-3-carboxylic acid; 1,2,5,6-tetrahydropyridine-4-carboxylic acid; 3-amino-3-(2-chlorophenyl)-propionic acid; 3-amino-3-(2-thienyl)-propionic acid; 3-amino-3-(3-bromophenyl)-propionic acid; 3-amino-3-(4-chlorophenyl)-propionic acid; 3-amino-3-(4-methoxyphenyl)-propionic acid; 3-amino-4,4,4-trifluoro-butyric acid; 3-aminoadipic acid; D-β-phenylalanine; 3-leucine; L-β-homoalanine; L-β-homoaspartic acid γ-benzyl ester; L-β-homoglutamic acid δ-benzyl ester; L-β-homoisoleucine; L-β-homoleucine; L-β-homomethionine; L-β-homophenylalanine; L-β-homoproline; L-β-homotryptophan; L-β-homovaline; L-Nω-benzyloxycarbonyl-β-homolysine; Nω-L-β-homoarginine; O-benzyl-L-β-homohydroxyproline; O-benzyl-L-β-homoserine; O-benzyl-L-β-homothreonine; O-benzyl-L-β-homotyrosine; γ-trityl-L-β-homoasparagine; (R)-β-phenylalanine; L-β-homoaspartic acid γ-t-butyl ester; L-β-homoglutamic acid δ-t-butyl ester; L-Nω-β-homolysine; Nδ-trityl-L-β-homoglutamine; Nω-2,2,4,6,7-pentamethyl-dihydrobenzofuran-5-sulfonyl-L-β-homoarginine; O-t-butyl-L-β-homohydroxy-proline; O-t-butyl-L-β-homoserine; O-t-butyl-L-β-homothreonine; O-t-butyl-L-β-homotyrosine; 2-aminocyclopentane carboxylic acid; and 2-aminocyclohexane carboxylic acid.

Amino acid analogs include analogs of alanine, valine, glycine or leucine.

Examples of amino acid analogs of alanine, valine, glycine, and leucine include, but are not limited to, the following: α-methoxyglycine; α-allyl-L-alanine; α-aminoisobutyric acid; α-methyl-leucine; β-(1-naphthyl)-D-alanine; β-(1-naphthyl)-L-alanine; β-(2-naphthyl)-D-alanine; β-(2-naphthyl)-L-alanine; β-(2-pyridyl)-D-alanine; β-(2-pyridyl)-L-alanine; β-(2-thienyl)-D-alanine; β-(2-thienyl)-L-alanine; P3-(3-benzothienyl)-L-alanine; β-(3-benzothienyl)-L-alanine; β-(3-pyridyl)-D-alanine; β-(3-pyridyl)-L-alanine; β-(4-pyridyl)-D-alanine; β-(4-pyridyl)-L-alanine; β-chloro-L-alanine; β-cyano-L-alanin; β-cyclohexyl-D-alanine; β-cyclohexyl-L-alanine; β-cyclopenten-1-yl-alanine; β-cyclopentyl-alanine; β-cyclopropyl-L-Ala-OH.dicyclohexylammonium salt; β-t-butyl-D-alanine; β-t-butyl-L-alanine; γ-aminobutyric acid; L-α,β-diaminopropionic acid; 2,4-dinitro-phenylglycine; 2,5-dihydro-D-phenylglycine; 2-amino-4,4,4-trifluorobutyric acid; 2-fluoro-phenylglycine; 3-amino-4,4,4-trifluoro-butyric acid; 3-fluoro-valine; 4,4,4-trifluoro-valine; 4,5-dehydro-L-leu-OH.dicyclohexylammonium salt; 4-fluoro-D-phenylglycine; 4-fluoro-L-phenylglycine; 4-hydroxy-D-phenylglycine; 5,5,5-trifluoro-leucine; 6-aminohexanoic acid; cyclopentyl-D-Gly-OH.dicyclohexylammonium salt; cyclopentyl-Gly-OH.dicyclohexylammonium salt; D-α,β-diaminopropionic acid; D-α-aminobutyric acid; D-α-t-butylglycine; D-(2-thienyl)glycine; D-(3-thienyl)glycine; D-2-aminocaproic acid; D-2-indanylglycine; D-allylglycine*dicyclohexylammonium salt; D-cyclohexylglycine; D-norvaline; D-phenylglycine; β-aminobutyric acid; β-aminoisobutyric acid; (2-bromophenyl)glycine; (2-methoxyphenyl)glycine; (2-methylphenyl)glycine; (2-thiazoyl)glycine; (2-thienyl)glycine; 2-amino-3-(dimethylamino)-propionic acid; L-α,β-diaminopropionic acid; L-α-aminobutyric acid; L-α-t-butylglycine; L-(3-thienyl)glycine; L-2-amino-3-(dimethylamino)-propionic acid; L-2-aminocaproic acid dicyclohexyl-ammonium salt; L-2-indanylglycine; L-allylglycine.dicyclohexyl ammonium salt; L-cyclohexylglycine; L-phenylglycine; L-propargylglycine; L-norvaline; N-α-aminomethyl-L-alanine; D-α,γ-diaminobutyric acid; L-α,γ-diaminobutyric acid; β-cyclopropyl-L-alanine; (N-β-(2,4-dinitrophenyl))-L-α,β-diaminopropionic acid; (N-β-1-(4,4-dimethyl-2,6-dioxocyclohex-1-ylidene)ethyl)-D-α,β-diaminopropionic acid; (N-β-1-(4,4-dimethyl-2,6-dioxocyclohex-1-ylidene)ethyl)-L-α,β-diaminopropionic acid; (N-β-4-methyltrityl)-L-α,β-diaminopropionic acid; (N-β-allyloxycarbonyl)-L-α,β-diaminopropionic acid; (N-γ-1-(4,4-dimethyl-2,6-dioxocyclohex-1-ylidene)ethyl)-D-α,γ-diaminobutyric acid; (N-γ-1-(4,4-dimethyl-2,6-dioxocyclohex-1-ylidene)ethyl)-L-α,γ-diaminobutyric acid; (N-γ-4-methyltrityl)-D-α,γ-diaminobutyric acid; (N-γ-4-methyltrityl)-L-α,γ-diaminobutyric acid; (N-γ-allyloxycarbonyl)-L-α,γ-diaminobutyric acid; D-α,γ-diaminobutyric acid; 4,5-dehydro-L-leucine; cyclopentyl-D-Gly-OH; cyclopentyl-Gly-OH; D-allylglycine; D-homocyclohexylalanine; L-1-pyrenylalanine; L-2-aminocaproic acid; L-allylglycine; L-homocyclohexylalanine; and N-(2-hydroxy-4-methoxy-Bzl)-Gly-OH.

Amino acid analogs include analogs of arginine or lysine. Examples of amino acid analogs of arginine and lysine include, but are not limited to, the following: citrulline; L-2-amino-3-guanidinopropionic acid; L-2-amino-3-ureido-propionic acid; L-citrulline; Lys(Me)$_2$-OH; Lys(N$_3$)—OH; Nδ-benzyloxycarbonyl-L-ornithine; Nω-nitro-D-arginine; Nω-nitro-L-arginine; α-methyl-ornithine; 2,6-diaminoheptanedioic acid; L-ornithine; (Nδ-1-(4,4-dimethyl-2,6-dioxocyclohex-1-ylidene)ethyl)-D-ornithine; (Nδ-1-(4,4-dimethyl-2,6-dioxo-cyclohex-1-ylidene)ethyl)-L-ornithine; (Nδ-4-methyltrityl)-D-ornithine; (Nδ-4-methyltrityl)-L-ornithine; D-ornithine; L-ornithine; Arg(Me)(Pbf)-OH; Arg(Me)$_2$-OH (asymmetrical); Arg(Me)$_2$-OH (symmetrical); Lys(ivDde)-OH; Lys(Me)$_2$-OH.HCl; Lys(Me3)-OH chloride; Nω-nitro-D-arginine; and Nω-nitro-L-arginine.

Amino acid analogs include analogs of aspartic or glutamic acids. Examples of amino acid analogs of aspartic and glutamic acids include, but are not limited to, the following: α-methyl-D-aspartic acid; α-methyl-glutamic acid; α-methyl-L-aspartic acid; γ-methylene-glutamic acid; (N-γ-ethyl)-L-glutamine; [N-α-(4-aminobenzoyl)]-L-glutamic acid; 2,6-diaminopimelic acid; L-α-aminosuberic acid; D-2-aminoadipic acid; D-α-aminosuberic acid; α-aminopimelic acid; iminodiacetic acid; L-2-aminoadipic acid; threo-β-methyl-aspartic acid; γ-carboxy-D-glutamic acid γ,γ-di-t-butyl ester; γ-carboxy-L-glutamic acid γ,γ-di-t-butyl ester; Glu(OAll)-OH; L-Asu(OtBu)-OH; and pyroglutamic acid.

Amino acid analogs include analogs of cysteine and methionine. Examples of amino acid analogs of cysteine and methionine include, but are not limited to, Cys(farnesyl)-OH, Cys(farnesyl)-OMe, α-methyl-methionine, Cys(2-hydroxyethyl)-OH, Cys(3-aminopropyl)-OH, 2-amino-4-(ethylthio)butyric acid, buthionine, buthioninesulfoximine, ethionine, methionine methylsulfonium chloride, selenomethionine, cysteic acid, [2-(4-pyridyl)ethyl]-DL-penicillamine, [2-(4-pyridyl)ethyl]-L-cysteine, 4-methoxybenzyl-D-penicillamine, 4-methoxybenzyl-L-penicillamine, 4-methylbenzyl-D-penicillamine, 4-methylbenzyl-L-penicillamine, benzyl-D-cysteine, benzyl-L-cysteine, benzyl-DL-homocysteine, carbamoyl-L-cysteine, carboxyethyl-L-cysteine, carboxymethyl-L-cysteine, diphenylmethyl-L-cysteine, ethyl-L-cysteine, methyl-L-cysteine, t-butyl-D-cysteine, trityl-L-homocysteine, trityl-D-penicillamine, cystathionine, homocystine, L-homocystine, (2-aminoethyl)-L-cysteine, seleno-L-cystine, cystathionine, Cys(StBu)-OH, and acetamidomethyl-D-penicillamine.

Amino acid analogs include analogs of phenylalanine and tyrosine. Examples of amino acid analogs of phenylalanine and tyrosine include β-methyl-phenylalanine, β-hydroxyphenylalanine, α-methyl-3-methoxy-DL-phenylalanine, α-methyl-D-phenylalanine, α-methyl-L-phenylalanine, 1,2,3,4-tetrahydroisoquinoline-3-carboxylic acid, 2,4-dichlorophenylalanine, 2-(trifluoromethyl)-D-phenylalanine, 2-(trifluoromethyl)-L-phenylalanine, 2-bromo-D-phenylalanine, 2-bromo-L-phenylalanine, 2-chloro-D-phenylalanine, 2-chloro-L-phenylalanine, 2-cyano-D-phenylalanine, 2-cyano-L-phenylalanine, 2-fluoro-D-phenylalanine, 2-fluoro-L-phenylalanine, 2-methyl-D-phenylalanine, 2-methyl-L-phenylalanine, 2-nitro-D-phenylalanine, 2-nitro-L-phenylalanine, 2;4;5-trihydroxy-phenylalanine, 3,4,5-trifluoro-D-phenylalanine, 3,4,5-trifluoro-L-phenylalanine, 3,4-dichloro-D-phenylalanine, 3,4-dichloro-L-phenylalanine, 3,4-difluoro-D-phenylalanine, 3,4-difluoro-L-phenylalanine, 3,4-dihydroxy-L-phenylalanine, 3,4-dimethoxy-L-phenylalanine, 3,5,3'-triiodo-L-thyronine, 3,5-diiodo-D-tyrosine, 3,5-diiodo-L-tyrosine, 3,5-diiodo-L-thyronine, 3-(trifluoromethyl)-D-phenylalanine, 3-(trifluoromethyl)-L-phenylalanine, 3-amino-L-tyrosine, 3-bromo-D-phenylalanine, 3-bromo-L-phenylalanine, 3-chloro-D-phenylalanine, 3-chloro-L-phenylalanine, 3-chloro-L-tyrosine, 3-cyano-D-phenylalanine, 3-cyano-L-phenylalanine, 3-fluoro-D-phenylalanine, 3-fluoro-L-phenylalanine, 3-fluoro-tyrosine, 3-iodo-D-phenylalanine, 3-iodo-L-phenylalanine, 3-iodo-L-tyrosine, 3-methoxy-L-tyrosine, 3-methyl-D-phenylalanine, 3-methyl-L-phenylalanine, 3-nitro-D-phenylalanine, 3-nitro-L-phenylalanine, 3-nitro-L-tyrosine, 4-(trifluoromethyl)-D-phenylalanine, 4-(trifluoromethyl)-L-phenylalanine, 4-amino-D-phenylalanine, 4-amino-L-phenylalanine, 4-benzoyl-D-phenylalanine, 4-benzoyl-L-phenylalanine, 4-bis(2-chloroethyl)amino-L-phenylalanine, 4-bromo-D-phenylalanine, 4-bromo-L-phenylalanine, 4-chloro-D-phenylalanine, 4-chloro-L-phenylalanine, 4-cyano-D-phenylalanine, 4-cyano-L-phenylalanine, 4-fluoro-D-phenylalanine, 4-fluoro-L-phenylalanine, 4-iodo-D-phenylalanine, 4-iodo-L-phenylalanine, homophenylalanine, thyroxine, 3,3-diphenylalanine, thyronine, ethyl-tyrosine, and methyl-tyrosine.

Amino acid analogs include analogs of proline. Examples of amino acid analogs of proline include, but are not limited to, 3,4-dehydro-proline, 4-fluoro-proline, cis-4-hydroxy-proline, thiazolidine-2-carboxylic acid, and trans-4-fluoro-proline.

Amino acid analogs include analogs of serine and threonine. Examples of amino acid analogs of serine and threonine include, but are not limited to, 3-amino-2-hydroxy-5-methylhexanoic acid, 2-amino-3-hydroxy-4-met hylpentanoic acid, 2-amino-3-ethoxybutanoic acid, 2-amino-3-methoxybutanoic acid, 4-amino-3-hydroxy-6-methylheptanoic acid, 2-amino-3-benzyloxypropionic acid, 2-amino-3-benzyloxypropionic acid, 2-amino-3-ethoxypropionic acid, 4-amino-3-hydroxybutanoic acid, and α-methylserine.

Amino acid analogs include analogs of tryptophan. Examples of amino acid analogs of tryptophan include, but are not limited to, the following: α-methyl-tryptophan; β-(3-benzothienyl)-D-alanine; β-(3-benzothienyl)-L-alanine; I-methyl-tryptophan; 4-methyl-tryptophan; 5-benzyloxy-tryptophan; 5-bromo-tryptophan; 5-chloro-tryptophan; 5-fluoro-tryptophan; 5-hydroxy-tryptophan; 5-hydroxy-L-tryptophan; 5-methoxy-tryptophan; 5-methoxy-L-tryptophan; 5-methyl-tryptophan; 6-bromo-tryptophan; 6-chloro-D-tryptophan; 6-chloro-tryptophan; 6-fluoro-tryptophan; 6-methyl-tryptophan; 7-benzyloxy-tryptophan; 7-bromo-tryptophan; 7-methyl-tryptophan; D-1,2,3,4-tetrahydro-norharman-3-carboxylic acid; 6-methoxy-1,2,3,4-tetrahydronorharman-1-carboxylic acid; 7-azatryptophan; L-1,2,3,4-tetrahydro-norharman-3-carboxylic acid; 5-methoxy-2-methyl-tryptophan; and 6-chloro-L-tryptophan.

In some embodiments, amino acid analogs are racemic. In some embodiments, the D isomer of the amino acid analog is used. In some embodiments, the L isomer of the amino acid analog is used. In other embodiments, the amino acid analog comprises chiral centers that are in the R or S configuration. In still other embodiments, the amino group(s) of a β-amino acid analog is substituted with a protecting group, e.g., tert-butyloxycarbonyl (BOC group), 9-fluorenylmethyloxycarbonyl (FMOC), tosyl, and the like. In yet other embodiments, the carboxylic acid functional group of a β-amino acid analog is protected, e.g., as its ester derivative. In some embodiments the salt of the amino acid analog is used.

A "non-essential" amino acid residue is a residue that can be altered from the wild-type sequence of a polypeptide without abolishing or substantially altering its essential biological or biochemical activity (e.g., receptor binding or activation). An "essential" amino acid residue is a residue that, when altered from the wild-type sequence of the polypeptide, results in abolishing or substantially abolishing the polypeptide's essential biological or biochemical activity.

A "conservative amino acid substitution" is one in which the amino acid residue is replaced with an amino acid residue having a similar side chain. Families of amino acid residues having similar side chains have been defined in the art. These families include amino acids with basic side chains (e.g., K, R, H), acidic side chains (e.g., D, E), uncharged polar side chains (e.g., G, N, Q, S, T, Y, C), nonpolar side chains (e.g., A, V, L, I, P, F, M, W), beta-branched side chains (e.g., T, V, I) and aromatic side chains (e.g., Y, F, W, H). Thus, a predicted nonessential amino acid residue in a polypeptide, for example, is replaced with another amino acid residue from the same side chain family. Other examples of acceptable substitutions are substitutions based on isosteric considerations (e.g. norleucine for methionine) or other properties (e.g. 2-thienylalanine for phenylalanine, or 6-Cl-tryptophan for tryptophan).

The term "capping group" refers to the chemical moiety occurring at either the carboxy or amino terminus of the polypeptide chain of the subject peptidomimetic macrocycle. The capping group of a carboxy terminus includes an unmodified carboxylic acid (i.e. —COOH) or a carboxylic acid with a substituent. For example, the carboxy terminus can be substituted with an amino group to yield a carboxamide at the C-terminus. Various substituents include but are not limited to primary and secondary amines, including pegylated secondary amines. Representative secondary amine capping groups for the C-terminus include:

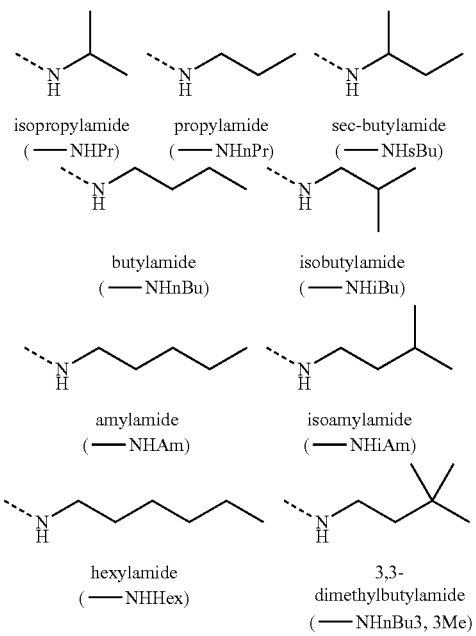

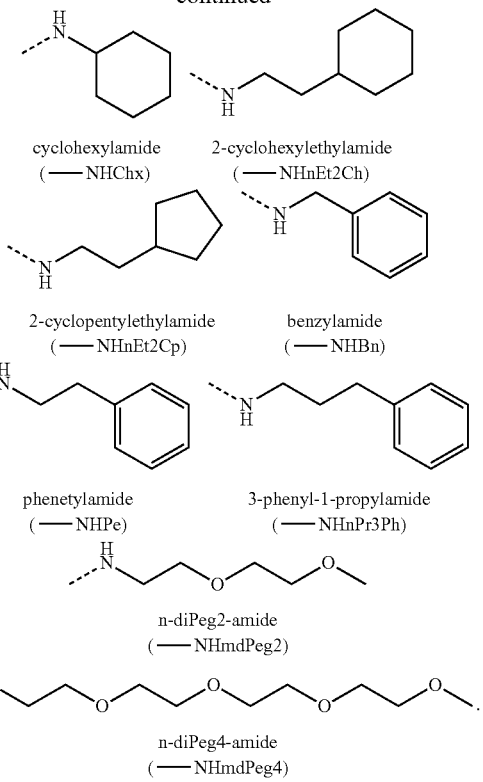

The capping group of an amino terminus includes an unmodified amine (ie —NH$_2$) or an amine with a substituent. For example, the amino terminus can be substituted with an acyl group to yield a carboxamide at the N-terminus. Various substituents include but are not limited to substituted acyl groups, including C$_1$-C$_6$ carbonyls, C$_7$-C$_{30}$ carbonyls, and pegylated carbamates. Representative capping groups for the N-terminus include, but are not limited to, 4-FBzl (4-fluoro-benzyl) and the following:

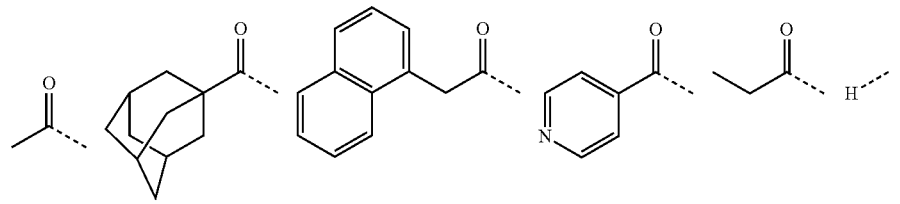

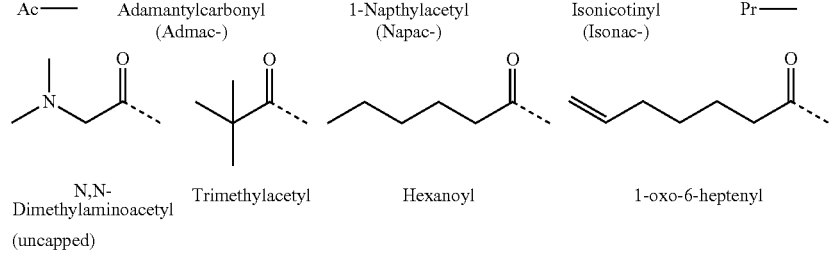

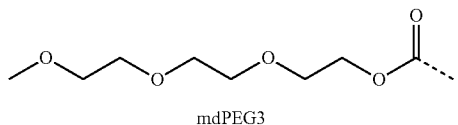
mdPEG3

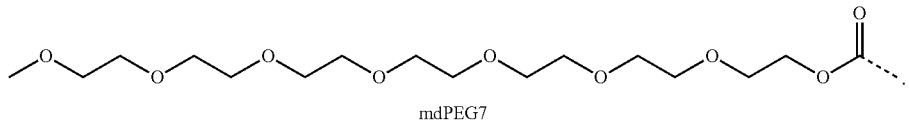
mdPEG7

The term "member" as used herein in conjunction with macrocycles or macrocycle-forming linkers refers to the atoms that form or can form the macrocycle, and excludes substituent or side chain atoms. By analogy, cyclodecane, 1,2-difluoro-decane and 1,3-dimethyl cyclodecane are all considered ten-membered macrocycles as the hydrogen or fluoro substituents or methyl side chains do not participate in forming the macrocycle.

The symbol "⫽" when used as part of a molecular structure refers to a single bond or a trans or cis double bond.

The term "amino acid side chain" refers to a moiety attached to the α-carbon (or another backbone atom) in an amino acid. For example, the amino acid side chain for alanine is methyl, the amino acid side chain for phenylalanine is phenylmethyl, the amino acid side chain for cysteine is thiomethyl, the amino acid side chain for aspartate is carboxymethyl, the amino acid side chain for tyrosine is 4-hydroxyphenylmethyl, etc. Other non-naturally occurring amino acid side chains are also included, for example, those that occur in nature (e.g., an amino acid metabolite) or those that are made synthetically (e.g., an α,αdi-substituted amino acid).

The term "α,αdi-substituted amino" acid refers to a molecule or moiety containing both an amino group and a carboxyl group bound to a carbon (the α-carbon) that is attached to two natural or non-natural amino acid side chains.

The term "polypeptide" encompasses two or more naturally or non-naturally-occurring amino acids joined by a covalent bond (e.g., an amide bond). Polypeptides as described herein include full length proteins (e.g., fully processed proteins) as well as shorter amino acid sequences (e.g., fragments of naturally-occurring proteins or synthetic polypeptide fragments).

The term "first C-terminal amino acid" refers to the amino acid which is closest to the C-terminus. The term "second C-terminal amino acid" refers to the amino acid attached at the N-terminus of the first C-terminal amino acid.

The term "macrocyclization reagent" or "macrocycle-forming reagent" as used herein refers to any reagent which can be used to prepare a peptidomimetic macrocycle by mediating the reaction between two reactive groups. Reactive groups can be, for example, an azide and alkyne, in which case macrocyclization reagents include, without limitation, Cu reagents such as reagents which provide a reactive Cu(I) species, such as CuBr, CuI or CuOTf, as well as Cu(II) salts such as Cu(CO₂CH₃)₂, CuSO₄, and CuCl₂ that can be converted in situ to an active Cu(I) reagent by the addition of a reducing agent such as ascorbic acid or sodium ascorbate. Macrocyclization reagents can additionally include, for example, Ru reagents known in the art such as Cp*RuCl (PPh₃)₂, [Cp*RuCl]₄ or other Ru reagents which can provide a reactive Ru(II) species. In other cases, the reactive groups are terminal olefins. In such embodiments, the macrocyclization reagents or macrocycle-forming reagents are metathesis catalysts including, but not limited to, stabilized, late transition metal carbene complex catalysts such as Group VIII transition metal carbene catalysts. For example, such catalysts are Ru and Os metal centers having a +2 oxidation state, an electron count of 16 and pentacoordinated. In other examples, catalysts have W or Mo centers. Various catalysts are disclosed in Grubbs et al., "Ring Closing Metathesis and Related Processes in Organic Synthesis" Acc. Chem. Res. 1995, 28, 446-452, U.S. Pat. Nos. 5,811,515; 7,932,397; U.S. Application No. 2011/0065915; U.S. Application No. 2011/0245477; Yu et al., "Synthesis of Macrocyclic Natural Products by Catalyst-Controlled Stereoselective Ring-Closing Metathesis," Nature 2011, 479, 88; and Peryshkov et al., "Z-Selective Olefin Metathesis Reactions Promoted by Tungsten Oxo Alkylidene Complexes," J. Am. Chem. Soc. 2011, 133, 20754. In yet other cases, the reactive groups are thiol groups. In such embodiments, the macrocyclization reagent is, for example, a linker functionalized with two thiol-reactive groups such as halogen groups. In some examples, the macrocyclization reagent include palladium reagents, for example Pd(PPh₃)₄, Pd(PPh₃)₂Cl₂, Pd(dppe) Cl, Pd(dppp)Cl₂, and Pd(dppf)Cl₂.

The term "halo" or "halogen" refers to fluorine, chlorine, bromine or iodine or a radical thereof.

The term "alkyl" refers to a hydrocarbon chain that is a straight chain or branched chain, containing the indicated number of carbon atoms. For example, $C_1$-$C_{10}$ indicates that the group has from 1 to 10 (inclusive) carbon atoms in it. In the absence of any numerical designation, "alkyl" is a chain (straight or branched) having 1 to 20 (inclusive) carbon atoms in it.

The term "alkylene" refers to a divalent alkyl (i.e., —R—).

The term "alkenyl" refers to a hydrocarbon chain that is a straight chain or branched chain having one or more carbon-carbon double bonds. The alkenyl moiety contains the indicated number of carbon atoms. For example, $C_2$-$C_{10}$ indicates that the group has from 2 to 10 (inclusive) carbon atoms in it. The term "lower alkenyl" refers to a $C_2$-$C_6$ alkenyl chain. In the absence of any numerical designation, "alkenyl" is a chain (straight or branched) having 2 to 20 (inclusive) carbon atoms in it.

The term "alkynyl" refers to a hydrocarbon chain that is a straight chain or branched chain having one or more carbon-carbon triple bonds. The alkynyl moiety contains the indicated number of carbon atoms. For example, $C_2$-$C_{10}$ indicates that the group has from 2 to 10 (inclusive) carbon atoms in it. The term "lower alkynyl" refers to a $C_2$-$C_6$ alkynyl chain. In the absence of any numerical designation, "alkynyl" is a chain (straight or branched) having 2 to 20 (inclusive) carbon atoms in it.

The term "aryl" refers to a 6-carbon monocyclic or 10-carbon bicyclic aromatic ring system wherein 0, 1, 2, 3, or 4 atoms of each ring are substituted by a substituent. Examples of aryl groups include phenyl, naphthyl and the like. The term "arylalkoxy" refers to an alkoxy substituted with aryl.

"Arylalkyl" refers to an aryl group, as defined above, wherein one of the aryl group's hydrogen atoms has been replaced with a $C_1$-$C_5$ alkyl group, as defined above. Representative examples of an arylalkyl group include, but are not limited to, 2-methylphenyl, 3-methylphenyl, 4-methylphenyl, 2-ethylphenyl, 3-ethylphenyl, 4-ethylphenyl, 2-propylphenyl, 3-propylphenyl, 4-propylphenyl, 2-butylphenyl, 3-butylphenyl, 4-butylphenyl, 2-pentylphenyl, 3-pentylphenyl, 4-pentylphenyl, 2-isopropylphenyl, 3-isopropylphenyl, 4-isopropylphenyl, 2-isobutylphenyl, 3-isobutylphenyl, 4-isobutylphenyl, 2-sec-butylphenyl, 3-sec-butylphenyl, 4-sec-butylphenyl, 2-t-butylphenyl, 3-t-butylphenyl and 4-t-butylphenyl.

"Arylamido" refers to an aryl group, as defined above, wherein one of the aryl group's hydrogen atoms has been replaced with one or more —C(O)NH$_2$ groups. Representative examples of an arylamido group include 2-C(O)NH2-phenyl, 3-C(O)NH$_2$-phenyl, 4-C(O)NH$_2$-phenyl, 2-C(O)NH$_2$-pyridyl, 3-C(O)NH$_2$-pyridyl, and 4-C(O)NH$_2$-pyridyl.

"Alkylheterocycle" refers to a $C_1$-$C_5$ alkyl group, as defined above, wherein one of the $C_1$-$C_5$ alkyl group's hydrogen atoms has been replaced with a heterocycle. Representative examples of an alkylheterocycle group include, but are not limited to, —CH$_2$CH$_2$-morpholine, —CH$_2$CH$_2$-piperidine, —CH$_2$CH$_2$CH$_2$-morpholine, and —CH$_2$CH$_2$CH$_2$-imidazole.

"Alkylamido" refers to a $C_1$-$C_5$ alkyl group, as defined above, wherein one of the $C_1$-$C_5$ alkyl group's hydrogen atoms has been replaced with a —C(O)NH$_2$ group. Representative examples of an alkylamido group include, but are not limited to, —CH$_2$—C(O)NH$_2$, —CH$_2$CH$_2$—C(O)NH$_2$, —CH$_2$CH$_2$CH$_2$C(O)NH$_2$, —CH$_2$CH$_2$CH$_2$CH$_2$C(O)NH$_2$, —CH$_2$CH$_2$CH$_2$CH$_2$CH$_2$C(O)NH$_2$, —CH$_2$CH(C(O)NH$_2$)CH$_3$, —CH$_2$CH(C(O)NH$_2$)CH$_2$CH$_3$, —CH(C(O)NH$_2$)CH$_2$CH$_3$, —C(CH$_3$)$_2$CH$_2$C(O)NH$_2$, —CH$_2$—CH$_2$—NH—C(O)—CH$_3$, —CH$_2$—CH$_2$—NH—C(O)—CH$_3$—CH3, and —CH$_2$—CH$_2$—NH—C(O)—CH=CH$_2$.

"Alkanol" refers to a $C_1$-$C_5$ alkyl group, as defined above, wherein one of the $C_1$-$C_5$ alkyl group's hydrogen atoms has been replaced with a hydroxyl group. Representative examples of an alkanol group include, but are not limited to, —CH$_2$OH, —CH$_2$CH$_2$OH, —CH$_2$CH$_2$CH$_2$OH, —CH$_2$CH$_2$CH$_2$CH$_2$OH, —CH$_2$CH$_2$CH$_2$CH$_2$CH$_2$OH, —CH$_2$CH(OH)CH$_3$, —CH$_2$CH(OH)CH$_2$CH$_3$, —CH(OH)CH$_3$ and —C(CH$_3$)$_2$CH$_2$OH.

"Alkylcarboxy" refers to a $C_1$-$C_5$ alkyl group, as defined above, wherein one of the $C_1$-$C_5$ alkyl group's hydrogen atoms has been replaced with a —COOH group. Representative examples of an alkylcarboxy group include, but are not limited to, —CH$_2$COOH, —CH$_2$CH$_2$COOH, —CH$_2$CH$_2$CH$_2$COOH, —CH$_2$CH$_2$CH$_2$CH$_2$COOH, —CH$_2$CH(COOH)CH$_3$, —CH$_2$CH$_2$CH$_2$CH$_2$CH$_2$COOH, —CH$_2$CH(COOH)CH$_2$CH$_3$, —CH(COOH)CH$_2$CH$_3$ and —C(CH$_3$)$_2$CH$_2$COOH.

The term "cycloalkyl" as employed herein includes saturated and partially unsaturated cyclic hydrocarbon groups having 3 to 12 carbons, preferably 3 to 8 carbons, and more preferably 3 to 6 carbons, wherein the cycloalkyl group additionally is optionally substituted. Some cycloalkyl groups include, without limitation, cyclopropyl, cyclobutyl, cyclopentyl, cyclopentenyl, cyclohexyl, cyclohexenyl, cycloheptyl, and cyclooctyl.

The term "heteroaryl" refers to an aromatic 5-8 membered monocyclic, 8-12 membered bicyclic, or 11-14 membered tricyclic ring system having 1-3 heteroatoms if monocyclic, 1-6 heteroatoms if bicyclic, or 1-9 heteroatoms if tricyclic, said heteroatoms selected from O, N, or S (e.g., carbon atoms and 1-3, 1-6, or 1-9 heteroatoms of O, N, or S if monocyclic, bicyclic, or tricyclic, respectively), wherein 0, 1, 2, 3, or 4 atoms of each ring are substituted by a substituent. Examples of heteroaryl groups include pyridyl, furyl or furanyl, imidazolyl, benzimidazolyl, pyrimidinyl, thiophenyl or thienyl, quinolinyl, indolyl, thiazolyl, and the like.

The term "heteroarylalkyl" or the term "heteroaralkyl" refers to an alkyl substituted with a heteroaryl. The term "heteroarylalkoxy" refers to an alkoxy substituted with heteroaryl.

The term "heteroarylalkyl" or the term "heteroaralkyl" refers to an alkyl substituted with a heteroaryl. The term "heteroarylalkoxy" refers to an alkoxy substituted with heteroaryl.

The term "heterocyclyl" refers to a nonaromatic 5-8 membered monocyclic, 8-12 membered bicyclic, or 11-14 membered tricyclic ring system having 1-3 heteroatoms if monocyclic, 1-6 heteroatoms if bicyclic, or 1-9 heteroatoms if tricyclic, said heteroatoms selected from O, N, or S (e.g., carbon atoms and 1-3, 1-6, or 1-9 heteroatoms of O, N, or S if monocyclic, bicyclic, or tricyclic, respectively), wherein 0, 1, 2 or 3 atoms of each ring are substituted by a substituent. Examples of heterocyclyl groups include piperazinyl, pyrrolidinyl, dioxanyl, morpholinyl, tetrahydrofuranyl, and the like.

The term "substituent" refers to a group replacing a second atom or group such as a hydrogen atom on any molecule, compound or moiety. Suitable substituents include, without limitation, halo, hydroxy, mercapto, oxo, nitro, haloalkyl, alkyl, alkaryl, aryl, aralkyl, alkoxy, thioalkoxy, aryloxy, amino, alkoxycarbonyl, amido, carboxy, alkanesulfonyl, alkylcarbonyl, and cyano groups.

In some embodiments, the compounds disclosed herein contain one or more asymmetric centers and thus occur as racemates and racemic mixtures, single enantiomers, individual diastereomers and diastereomeric mixtures. All such isomeric forms of these compounds are included unless expressly provided otherwise. In some embodiments, the compounds disclosed herein are also represented in multiple tautomeric forms, in such instances, the compounds include all tautomeric forms of the compounds described herein (e.g., if alkylation of a ring system results in alkylation at multiple sites, the disclosure includes all such reaction products). All such isomeric forms of such compounds are included unless expressly provided otherwise. All crystal forms of the compounds described herein are included unless expressly provided otherwise.

As used herein, the terms "increase" and "decrease" mean, respectively, to cause a statistically significantly (i.e., $p<0.1$) increase or decrease of at least 5%.

As used herein, the recitation of a numerical range for a variable is intended to convey that the variable is equal to any of the values within that range. Thus, for a variable which is inherently discrete, the variable is equal to any integer value within the numerical range, including the end-points of the range. Similarly, for a variable which is inherently continuous, the variable is equal to any real value within the numerical range, including the end-points of the range. As an example, and without limitation, a variable which is described as having values between 0 and 2 takes the values 0, 1 or 2 if the variable is inherently discrete, and takes the values 0.0, 0.1, 0.01, 0.001, or any other real values ≥0 and ≤2 if the variable is inherently continuous.

As used herein, unless specifically indicated otherwise, the word "or" is used in the inclusive sense of "and/or" and not the exclusive sense of "either/or."

The term "on average" represents the mean value derived from performing at least three independent replicates for each data point.

The term "biological activity" encompasses structural and functional properties of a macrocycle. Biological activity is, for example, structural stability, alpha-helicity, affinity for a target, resistance to proteolytic degradation, cell penetrability, intracellular stability, in vivo stability, or any combination thereof.

The term "binding affinity" refers to the strength of a binding interaction, for example between a peptidomimetic macrocycle and a target. Binding affinity can be expressed, for example, as an equilibrium dissociation constant ("$K_D$"), which is expressed in units which are a measure of concentration (e.g. M, mM, μM, nM etc). Numerically, binding affinity and $K_D$ values vary inversely, such that a lower binding affinity corresponds to a higher $K_D$ value, while a higher binding affinity corresponds to a lower $K_D$ value. Where high binding affinity is desirable, "improved" binding affinity refers to higher binding affinity and therefore lower $K_D$ values.

The term "in vitro efficacy" refers to the extent to which a test compound, such as a peptidomimetic macrocycle, produces a beneficial result in an in vitro test system or assay. In vitro efficacy can be measured, for example, as an "$IC_{50}$" or "$EC_{50}$" value, which represents the concentration of the test compound which produces 50% of the maximal effect in the test system.

The term "ratio of in vitro efficacies" or "in vitro efficacy ratio" refers to the ratio of $IC_{50}$ or $EC_{50}$ values from a first assay (the numerator) versus a second assay (the denominator). Consequently, an improved in vitro efficacy ratio for Assay 1 versus Assay 2 refers to a lower value for the ratio expressed as $IC_{50}$ (Assay 1)/$IC_{50}$ (Assay 2) or alternatively as $EC_{50}$ (Assay 1)/$EC_{50}$ (Assay 2). This concept can also be characterized as "improved selectivity" in Assay 1 versus Assay 2, which can be due either to a decrease in the $IC_{50}$ or $EC_{50}$ value for Target 1 or an increase in the value for the $IC_{50}$ or $EC_{50}$ value for Target 2.

The term "liquid cancer" as used herein refers to cancer cells that are present in body fluids, such as blood, lymph and bone marrow. Liquid cancers include leukemia, myeloma, myelodysplastic syndrome (MDS), and liquid lymphomas. For example, liquid cancer can be acute myeloid leukemia (AML). Liquid lymphomas include lymphomas that contain cysts or liquid areas. Liquid cancers as used herein do not include solid tumors, such as sarcomas and carcinomas or solid lymphomas that do not contain cysts or liquid areas.

The term "adverse event" (AE) as used herein includes any noxious, pathological, or unintended change in anatomical, physiological, or metabolic functions as indicated by physical signs, symptoms, and/or laboratory changes occurring in any phase of the clinical study whether or not temporally associated with the administration of study medication and whether or not considered related to the study medication. This definition includes an exacerbation of pre-existing medical conditions or events, intercurrent illnesses, hypersensitivity reactions, drug interactions, or clinically significant laboratory findings. An AE does not include the following: (i) medical or surgical procedures, e.g., tooth extraction, transfusion, surgery (The medical condition that leads to the procedure is to be recorded as an AE); (ii) pre-existing conditions or procedures present or detected at the start of the study that do not worsen; (iii) hospitalization for elective surgeries or for other situations in which an untoward medical event has not occurred; (iv) abnormal laboratory value, unless it is clinically significant according to the Investigator, requires intervention, or results in a delay, discontinuation or change in the dose of study drug; (v) overdose of study drug or concomitant medication unaccompanied by signs/symptoms; if sign/symptoms occur, the final diagnosis should be recorded as an AE; (vi) pregnancy by itself, unless a complication occurs during pregnancy leading to hospitalization; in this case, the medical condition that leads to the hospitalization is to be recorded as the AE; and (vii) significant worsening of the disease under investigation which is captured as an efficacy parameter in this study and, thus, is not recorded as an AE.

The term serious adverse event (SAE) as used herein refers to an adverse event that results in any of the following outcomes: (i) death; (ii) life-threatening adverse experience (i.e., immediate risk of death from the event as it occurred; this does not include an adverse event that, had it occurred in a more serious form, might have caused death); (iii) persistent or significant disability/incapacitation; (iv) hospitalization or prolongation of existing hospitalization; and (v) congenital anomaly/birth defect. Important medical events that can not result in death, be life-threatening, or require hospitalization can be considered serious when, based on medical judgment, they can jeopardize the patient or can require medical or surgical intervention to prevent one of the outcomes listed in this definition. Hospitalizations due to the underlying disease will not be reported as an SAE unless there is reason to suspect a causal relationship with the study drug.

An AE or suspected adverse reaction is considered "unexpected" (referred to as Unexpected Adverse Event (UAE) if it is not listed in the peptidomimetic macrocycle Investigator's Brochure or is not listed at the specificity or severity that has been observed; or, is not consistent with the risk information described in the protocol or elsewhere. For example, under this definition, hepatic necrosis would be unexpected (by virtue of greater severity) if the Investigator's Brochure referred only to elevated hepatic enzymes or hepatitis. Similarly, cerebral thromboembolism and cerebral vasculitis would be unexpected (by virtue of greater specificity) if the Investigator's Brochure listed only cerebral vascular accidents. "Unexpected," as used in this definition, also refers to AEs or suspected adverse reactions that are mentioned in the Investigator's Brochure as occurring with a class of drugs or as anticipated from the pharmacological properties of the peptidomimetic macrocycle but are not specifically mentioned as occurring with the peptidomimetic macrocycle.

A "Dose-Limiting Toxicity" (DLT) as used herein is defined as any non hematologic Grade ≥3 AE that is considered to be possibly, probably, or definitely related to the study drug, with the following exceptions: (1) for fatigue, nausea, emesis, diarrhea or mucositis, all Grade 4 and any Grade 3 AE requiring total parenteral nutrition (TPN) or hospitalization will be considered DLT; (2) for electrolyte imbalances, only Grade ≥3 AE that do not respond to correction within 24 hours will be considered DLT; (3) for infusion reactions, only a Grade 3 reaction which caused hospitalization or Grade 4 will be considered DLT; (4) any grade alopecia; (5) any event that can clearly be determined to be unrelated to the study drug (e.g., solely related to disease progression). DLT also includes: i) ANC fails to recover to >0.5 Gi/L within 42 days from the start of therapy in the absence of active leukemia or myelodysplasia; and ii) Platelet count fails to recover to >20,000 or associated with clinically significant bleeding that requires transfusion of red cells or platelets within 42 days from the start of therapy in the absence of active leukemia or myelodysplasia. In addition, specific hematologic DLTs are defined as:
  (i) Thrombocytopenia-Grade 4 of any duration, Grade 3 for ≥7 days, or Grade 3 associated with clinically significant bleeding;
  (ii) Neutropenia-Grade 4 for ≥3 days, or any Grade ≥3 febrile neutropenia.

The above criteria can be used to make individual patient determinations regarding dose reductions, interruptions or discontinuation throughout the course of the trial, but DLTs occurring during Cycle 1 will be used to inform safety and tolerability assessments for dose escalation decisions. The DLT-evaluable population will include all patients in Phase 1 Dose Escalation who experience a DLT during the first cycle of treatment.

The "Maximum Tolerated Dose" (MTD) as used herein is defined as the dose at which ≤1 of 6 patients experiences a treatment-related toxicity that qualifies as a DLT, with the next higher dose having ≥2 of up to 6 patients experiencing a DLT. The MTD can not be established until all patients enrolled in the cohort have completed Cycle 1, discontinued treatment or had a dose reduction. Previously established tolerability of a dose level will be reevaluated if DLTs are observed in later cycles.

The term "subject" or "patient" encompasses mammals and non-mammals.

Examples of mammals include, but are not limited to, humans; non-human primates such as chimpanzees, and other apes and monkey species; farm animals such as cattle, horses, sheep, goats, swine; domestic animals such as rabbits, dogs, and cats; laboratory animals including rodents, such as rats, mice and guinea pigs, and the like. Examples of non-mammals include, but are not limited to, birds, fish and the like. In one embodiment of the methods and compositions provided herein, the mammal is a human.

The details of one or more particular embodiments of the invention are set forth in the accompanying drawings and the description below. Other features, objects, and advantages of the invention will be apparent from the description and drawings, and from the claims.

OVERVIEW

In one aspect, the disclosure provides a method of treating liquid cancer, determined to lack a p53 deactivating mutation, in a subject. The method comprises administering to the subject a therapeutically effective amount of a peptidomimetic macrocycle or a pharmaceutically acceptable salt thereof, wherein the peptidomimetic macrocycle binds to MDM2 and/or MDMX proteins. In some embodiments, the peptidomimetic macrocycle disrupts the interaction between p53 and MDM2 and MDMX.

In another aspect, the disclosure provides a method of treating liquid cancer in a subject expressing wild type p53. The method comprises administering to the subject a therapeutically effective amount of a peptidomimetic macrocycle or a pharmaceutically acceptable salt thereof, wherein the peptidomimetic macrocycle binds to MDM2 and/or MDMX proteins. In some embodiments, the peptidomimetic macrocycle disrupts the interaction between p53 and MDM2 and MDMX.

In some embodiments, a subject treated in accordance with the methods provided herein is a human who has or is diagnosed with liquid cancer lacking p53 deactivating mutation and/or expressing wild type p53. In some embodiments, a subject treated for liquid cancer in accordance with the methods provided herein is a human predisposed or susceptible to liquid cancer lacking p53 deactivating mutation and/or expressing wild type p53. In some embodiments, a subject treated for liquid cancer in accordance with the methods provided herein is a human at risk of developing liquid cancer lacking p53 deactivating mutation and/or expressing wild type p53. A p53 deactivating mutation in some example can be a mutation in DNA-binding domain of the p53 protein. In some examples the p53 deactivating mutation can be a missense mutation. In various examples, the liquid cancer can be determined to lack one or more p53 deactivating mutations selected from mutations at one or more of residues R175, G245, R248, R249, R273, and R282. The lack of p53 deactivating mutation and/or the presence of wild type p53 in the liquid cancer can be determined by any suitable method known in art, for example by sequencing, array based testing, RNA analysis and amplifications methods like PCR.

In certain embodiments, the human subject is refractory and/or intolerant to one or more other standard treatment of the liquid cancer known in art. In some embodiments, the human subject has had at least one unsuccessful prior treatment and/or therapy of the liquid cancer.

In some embodiments, the methods for treating liquid cancer provided herein inhibit, reduce, diminish, arrest, or stabilize a liquid cancer cell associated with the liquid cancer. In some embodiments, the methods for treating liquid cancer provided herein inhibit, reduce, diminish, arrest, or stabilize the blood flow, metabolism, or edema in a liquid cancer cell associated with the liquid cancer or one or more symptoms thereof. In some embodiments, the methods for treating liquid cancer provided herein cause the regression of the number of liquid cancer cells, or liquid cancer cell metabolism, and/or one or more symptoms associated with the liquid cancer. In some embodiments, the methods for treating liquid cancer provided herein maintain the number of CTCs and/or MNBCs so that the number of CTCs and/or MNBCs does not increase, or increases by less than the increase of the number of CTCs and/or MNBCs after administration of a standard therapy as measured by conventional methods available to one of skill in the art, such as ultrasound, CT Scan, MRI, dynamic contrast-enhanced MRI, or PET Scan. In specific embodiments, the methods for treating liquid cancer provided herein decrease liquid cancer cell number. In some embodiments, the methods for treating liquid cancer provided herein reduce the formation of CTCs and/or MNBCs. In certain embodiments, the methods for treating liquid cancer provided herein eradicate, remove, or control primary, regional and/or metastatic liquid cancer cells associated with the liquid cancer. In some embodiments, the methods for treating liquid cancer provided herein decrease the number or size of metastases associated with the liquid cancer. In some embodiments, the methods for treating liquid cancer provided herein result in complete response to the treatment. In some embodiments, the methods for treating liquid cancer provided herein result in partial response to the treatment. In some embodiments, the liquid cancer treated by the methods disclosed herein is a stable disease. In some embodiments, the liquid cancer treated by the methods disclosed herein is a progressive disease.

Liquid cancer cancers that can be treated by the methods provided herein include, but are not limited to, leukemias, myelomas, and liquid lymphomas. In specific embodiments, liquid cancers that can be treated in accordance with the methods described include, but are not limited to, liquid lymphomas, lekemias, and myelomas. Exemplary liquid lymphomas and leukemias that can be treated in accordance with the methods described include, but are not limited to, acute myelogenous leukemia (AML), myelodysplastic syndromes (MDS), chronic lymphocytic leukemia/small lymphocytic lymphoma, B-cell prolymphocytic leukemia, lymphoplasmacytic lymphoma (such as waldenstrom macroglobulinemia), splenic marginal zone lymphoma, plasma cell myeloma, plasmacytoma, monoclonal immunoglobulin deposition diseases, heavy chain diseases, extranodal marginal zone B cell lymphoma, also called malt lymphoma, nodal marginal zone B cell lymphoma (nmzl), follicular lymphoma, mantle cell lymphoma, diffuse large B cell lymphoma, mediastinal (thymic) large B cell lymphoma, intravascular large B cell lymphoma, primary effusion lymphoma, burkitt lymphoma/leukemia, T cell prolymphocytic leukemia, T cell large granular lymphocytic leukemia, aggressive NK cell leukemia, adult T cell leukemia/lymphoma, extranodal NK/T cell lymphoma, nasal type, enteropathy-type T cell lymphoma, hepatosplenic T cell lymphoma, blastic NK cell lymphoma, mycosis fungoides/sezary syndrome, primary cutaneous CD30-positive T cell lymphoproliferative disorders, primary cutaneous anaplastic large cell lymphoma, lymphomatoid papulosis, angioimmunoblastic T cell lymphoma, peripheral T cell lymphoma, unspecified, anaplastic large cell lymphoma, classical Hodgkin lymphomas (nodular sclerosis, mixed cellularity, lymphocyte-rich, lymphocyte depleted or not depleted), and nodular lymphocyte-predominant Hodgkin lymphoma.

In one aspect, myelodysplastic syndromes (MDS) is a heterogenous group of clonal, hematopoietic stem cell disorders characterized by distinct morphological bone marrow changes, abnormal blood counts, common cytogenetic abnormalities, and recurrent mutations. MDS can predominantly occur in the elderly. Treatment of MDS can be based on risk stratification, with the International Prognostic Scoring System (IPSS) or revised IPSS (IPSS-R) being the most common classification systems. Low-risk MDS patients can receive supportive care or hematopoietic growth factors. A subset of patients with 5q deletions can be treated with lenalidomide. High-risk patients can be treated with hypomethylating agents (e.g., azacitidine, decitabine), intensive chemotherapy, and/or allogeneic stem cell transplantation. In some cases, MDS patients can be transformed to AML. Some MDS patients can develop progressive bone marrow failure and/or die of complications related to neutropenia (e.g., infection) or thrombocytopenia (e.g., bleeding). Initial management of MDS can be based on risk stratification. The newer IPSS-R can place patients into 5 categories: very good, good, intermediate, high, and very-high risk groups. Patients in the very good, good, and select intermediate-risk patients can be categorized as "low-risk," whereas high, very high, and certain intermediate-risk patients can be categorized as the "high-risk" group. Azacitidine (5'-azacytidine) and decitabine (5'-aza-2'-deoxycytidine), which both are cytosine analogues, can lead to inhibition of DNA-methyltransferases (DNMTs) and can act as hypomethylating agents.

In another aspect, acute myeloid leukemia (AML) is characterized by the proliferation and accumulation of myeloid cells with accompanying hematopoietic failure. AML can be caused by chemical exposure, prior chemotherapy and radiation, or other environmental toxins.

Examples of liquid cancers includes cancers involving hyperplastic/neoplastic cells of hematopoietic origin, e.g., arising from myeloid, lymphoid or erythroid lineages, or precursor cells thereof. Exemplary disorders include: acute leukemias, e.g., erythroblastic leukemia and acute megakaryoblastic leukemia. Additional exemplary myeloid disorders include, but are not limited to, acute promyeloid leukemia (APML), acute myelogenous leukemia (AML) and chronic myelogenous leukemia (CML) (reviewed in Vaickus, L. (1991) Crit Rev. in Oncol./Hemotol. 11:267-97); lymphoid malignancies include, but are not limited to acute lymphoblastic leukemia (ALL) which includes B-lineage ALL and T-lineage ALL, chronic lymphocytic leukemia (CLL), prolymphocytic leukemia (PLL), multiple mylenoma, hairy cell leukemia (HLL) and Waldenstrom's macroglobulinemia (WM). Additional forms of malignant liquid lymphomas include, but are not limited to non-Hodgkin lymphoma and variants thereof, peripheral T cell lymphomas, adult T cell leukemia/lymphoma (ATL), cutaneous T-cell lymphoma (CTCL), large granular lymphocytic leukemia (LGF), Hodgkin's disease and Reed-Sternberg disease. For example, liquid cancers include, but are not limited to, acute lymphocytic leukemia (ALL); T-cell acute lymphocytic leukemia (T-ALL); anaplastic large cell lymphoma (ALCL); chronic myelogenous leukemia (CML); acute myeloid leukemia (AML); chronic lymphocytic leukemia (CLL); B-cell chronic lymphocytic leukemia (B-CLL); diffuse large B-cell lymphomas (DLBCL); hyper eosinophilia/chronic eosinophilia; and Burkitt's lymphoma.

In embodiments, the cancer comprises an acute lymphoblastic leukemia; acute myeloid leukemia; AIDS-related cancers; AIDS-related lymphoma; chronic lymphocytic leukemia; chronic myelogenous leukemia; chronic myeloproliferative disorders; cutaneous T-cell lymphoma; Hodgkin lymphoma; multiple myeloma; multiple myeloma/plasma cell neoplasm; Non-Hodgkin lymphoma; primary central nervous system (CNS) lymphoma; or T-cell lymphoma; In various embodiments, the liquid cancer can be B-Cell Chronic Lymphocytic Leukemia, B-Cell Lymphoma-DLBCL, B-Cell Lymphoma-DLBCL-germinal center-like, B-Cell Lymphoma-DLBCL-activated B-cell-like, or Burkitt's lymphoma.

The peptidomimetic macrocycle can be any cross-linked peptide, i.e. any peptide that comprises at least one macrocycle-forming linker which forms a macrocycle between a first amino acid residue (or analog) and a second amino acid residue. For example, the peptidomimetic macrocycle can be a peptidomimetic macrocycle capable of binding to the MDM2 and/or MDMX proteins. In some embodiments, the peptidomimetic macrocycles can be a peptidomimetic macrocycle of Formula I:

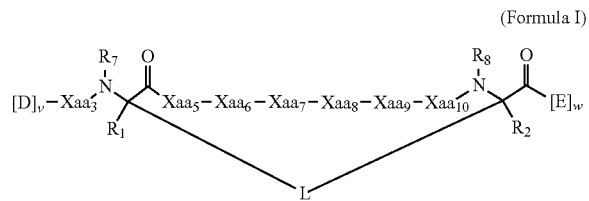

(Formula I)

wherein:

each of $Xaa_3$, $Xaa_5$, $Xaa_6$, $Xaa_7$, $Xaa_8$, $Xaa_9$, and $Xaa_{10}$ is individually an amino acid, wherein at least three of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$His_5$-$Tyr_6$-$Trp_7$-$Ala_8$-$Gln_9$-$Leu_{10}$-$X_{11}$-$Ser_{12}$ (SEQ ID NO: 8) or $Phe_3$-$X_4$-$Glu_5$-$Tyr_6$-$Trp$-$Ala$-$Gln_9$-$Leu_{10}$/$Cba_{10}$-$X_{11}$-$Ala_{12}$ (SEQ ID NO: 9), where each X is an amino acid;

each D and E is independently an amino acid;

$R_1$ and $R_2$ are independently —H, alkyl, alkenyl, alkynyl, arylalkyl, cycloalkyl, cycloalkylalkyl, heteroalkyl, or heterocycloalkyl, unsubstituted or substituted with halo-; or at least one of $R_1$ and $R_2$ forms a macrocycle-forming linker L' connected to the alpha position of one of said D or E amino acids;

each L or L' is independently a macrocycle-forming linker;

each $R_5$ is independently halogen, alkyl, —$OR_6$, —$N(R_6)_2$, —$SR_6$, —$SOR_6$, —$SO_2R_6$, —$CO_2R_6$, a fluorescent moiety, a radioisotope or a therapeutic agent;

each $R_6$ is independently —H, alkyl, alkenyl, alkynyl, arylalkyl, cycloalkylalkyl, heterocycloalkyl, a fluorescent moiety, a radioisotope or a therapeutic agent;

$R_7$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with a D residue;

$R_8$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with an E residue;

v is an integer from 1-1000, for example 1-500, 1-200, 1-100, 1-50, 1-30, 1-20, or 1-10; and w is an integer from 0-1000.

Administration of the peptidomimetic macrocycle can be achieved by any suitable means. For example the peptidomimetic macrocycle can be administered parenterally. For example, administration can be intravenous, intra-arterial, intraosseous infusion, intra-muscular, intracerebral, intracerebroventricular, intrathecal, or subcutaneous. In some embodiments administration is performed intravenously.

In some embodiments, the methods disclosed herein additionally or optionally comprise evaluating the safety and/or tolerability of the peptidomimetic macrocycles of the disclosure in subjects with liquid cancers determined to lack a p53 deactivating mutation or with liquid cancers expressing wild-type (WT) p53 protein.

Also provided here in are methods to determine the dose limiting toxicities (DLT) and the maximum tolerated dose (MTD or OBD) or the optimal biological dose (OBD) of the peptidomimetic macrocycles disclosed herein in subjects with liquid cancers determined to lack a p53 deactivating mutation or with liquid cancers expressing wild-type (WT) p53 protein.

In some embodiments, the methods disclosed herein additionally or optionally comprise the pharmacokinetic (PK) analysis of the peptidomimetic macrocycles and/or its metabolites in blood following single and/or multiple administration of the peptidomimetic macrocycles to the subject.

In some embodiments, the methods disclosed herein additionally or optionally comprise studying the effect of the peptidomimetic macrocycles on pharmacodynamic (PD) biomarkers in liquid cancer samples (including bone marrow aspirates), (e.g., p21, caspase, MDM2) and blood samples (e.g., macrophage inhibitory cytokine-1 [MIC-1]), and assessing possible correlation between these biomarkers and clinical response.

In some embodiments, the methods disclosed herein additionally or optionally include steps to assess potential patient biomarkers (e.g., p53 status, MDM2 and MDMX expression levels), the effect of the peptidomimetic macrocycles treatment on these biomarkers, and possible correlation between these biomarkers and clinical response of the peptidomimetic macrocycles.

Also provided herein are methods to evaluate clinical activity of the peptidomimetic macrocycles in subjects with specific liquid cancer types lacking a p53 deactivating mutation and/or expressing WT p53 in the dose expansion phase.

COMPOUND AND COMPOSITIONS

Peptidomimetic Macrocycles

In some embodiments, a peptidomimetic macrocycle has the Formula (I):

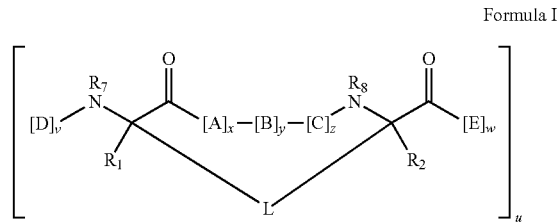

Formula I wherein:

each A, C, and D is independently an amino acid;

each B is independently an amino acid,

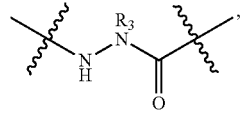

[—NH-$L_3$-CO—], [—NH-$L_3$-$SO_2$—], or [—NH-$L_3$-];

each E is independently an amino acid selected from the group consisting of Ala (alanine), D-Ala (D-alanine), Aib (α-aminoisobutyric acid), Sar (N-methyl glycine), and Ser (serine); each $R_3$ is independently hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with $R_5$; each $R_1$ and $R_2$ is independently —H, alkyl, alkenyl, alkynyl, arylalkyl, cycloalkyl, cycloalkylalkyl, heteroalkyl, or heterocycloalkyl, unsubstituted or substituted with halo-; or forms a macrocycle-forming linker L' connected to the alpha position of one of said D or E amino acids;

each L and L' is independently a macrocycle-forming linker;

each $L_3$ is independently alkylene, alkenylene, alkynylene, heteroalkylene, cycloalkylene, heterocycloalkylene, cycloarylene, heterocycloarylene, or [—$R_4$—K—$R_4$—]$_n$, each being optionally substituted with $R_5$;

each $R_4$ is independently alkylene, alkenylene, alkynylene, heteroalkylene, cycloalkylene, heterocycloalkylene, arylene, or heteroarylene;

each K is independently O, S, SO, $SO_2$, CO, $CO_2$, or $CONR_3$;

each $R_5$ is independently halogen, alkyl, —$OR_6$, —$N(R_6)_2$, —$SR_6$, —$SOR_6$, —$SO_2R_6$, —$CO_2R_6$, a fluorescent moiety, a radioisotope or a therapeutic agent;

each $R_6$ is independently —H, alkyl, alkenyl, alkynyl, arylalkyl, cycloalkylalkyl, heterocycloalkyl, a fluorescent moiety, a radioisotope or a therapeutic agent;

each $R_7$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with a D residue;

each $R_8$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with an E residue;

each v is independently an integer from 0-1000, for example, 0-500, 0-200, 0-100, 0-50, 0-30, 0-20, 0-10, 0-5, 1-1000, 1-500, 1-200, 1-100, 1-50, 1-30, 1-20, 1-10, 1-5, 3-1000, 3-500, 3-200, 3-100, 3-50, 3-30, 3-20, 3-10, 0, 1, 2, 3, 4, 5, 6, 7, 8, 9, or 10;

each w is independently an integer from 0-1000, for example, 0-500, 0-200, 0-100, 0-50, 0-30, 0-20, 0-10, 0-5, 1-1000, 1-500, 1-200, 1-100, 1-50, 1-30, 1-20, 1-10, 1-5, 3-1000, 3-500, 3-200, 3-100, 3-50, 3-30, 3-20, 3-10, 0, 1, 2, 3, 4, 5, 6, 7, 8, 9, or 10;

u is an integer from 1-10;

each x, y and z is independently an integer from 0-10; and each n is independently an integer from 1-5.

In some embodiments, each v and w is independently integers between 1-30. In some embodiments, w or v is an integer from 3-1000, for example 3-500, 3-200, 3-100, 3-50, 3-30, 3-20, or 3-10. In some embodiments, the sum of x+y+z is 3 or 6. In some embodiments, the sum of x+y+z is 3. In other embodiments, the sum of x+y+z is 6.

In some embodiments, peptidomimetic macrocycles are also provided of the formula:

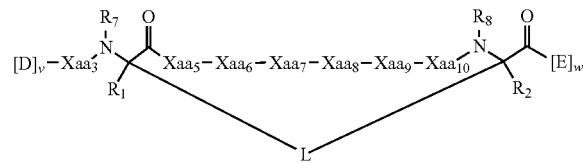

wherein:
each of $Xaa_3$, $Xaa_5$, $Xaa_6$, $Xaa_7$, $Xaa_8$, $Xaa_9$, and $Xaa_{10}$ is individually an amino acid, wherein at least three of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$His_5$s-$Tyr_6$-$Trp_7$-Ala-$Gln_9$-$Leu_{10}$-$X_{11}$-$Ser_{12}$ (SEQ ID NO: 8), where each X is an amino acid;

each D and E is independently an amino acid;

each $R_1$ and $R_2$ is independently —H, alkyl, alkenyl, alkynyl, arylalkyl, cycloalkyl, cycloalkylalkyl, heteroalkyl, or heterocycloalkyl, unsubstituted or substituted with halo-; or at least one of $R_1$ and $R_2$ forms a macrocycle-forming linker L' connected to the alpha position of one of said D or E amino acids or $Xaa_3$;

each L or L' is independently a macrocycle-forming linker;
each $R_5$ is independently halogen, alkyl, —$OR_6$, —$N(R_6)_2$, —$SR_6$, —$SOR_6$, —$SO_2R_6$, —$CO_2R_6$, a fluorescent moiety, a radioisotope or a therapeutic agent;

each $R_6$ is independently —H, alkyl, alkenyl, alkynyl, arylalkyl, cycloalkylalkyl, heterocycloalkyl, a fluorescent moiety, a radioisotope or a therapeutic agent;

each $R_7$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with a D residue;

each $R_8$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with an E residue;

v is an integer from 0-1000, for example, 0-500, 0-200, 0-100, 0-50, 0-30, 0-20, 0-10, 0-5, 1-1000, 1-500, 1-200, 1-100, 1-50, 1-30, 1-20, 1-10, 1-5, 3-1000, 3-500, 3-200, 3-100, 3-50, 3-30, 3-20, 3-10, 0, 1, 2, 3, 4, 5, 6, 7, 8, 9, or 10; and w is an integer from 0-1000, for example, 0-500, 0-200, 0-100, 0-50, 0-30, 0-20, 0-10, 0-5, 1-1000, 1-500, 1-200, 1-100, 1-50, 1-30, 1-20, 1-10, 1-5, 3-1000, 3-500, 3-200, 3-100, 3-50, 3-30, 3-20, 3-10, 0, 1, 2, 3, 4, 5, 6, 7, 8, 9, or 10.

In some embodiments, each v and w is independently an integer between 1-30. In some embodiments, w or v is an integer from 3-1000, for example 3-500, 3-200, 3-100, 3-50, 3-30, 3-20, or 3-10. In some embodiments, the sum of x+y+z is 3 or 6. In some embodiments, the sum of x+y+z is 3. In other embodiments, the sum of x+y+z is 6.

In some embodiments of any of the Formulas described herein, at least three of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$His_5$-$Tyr_6$-$Trp_7$-$Ala_8$-$Gln_9$-$Leu_{10}$-$X_1$-$Ser_{12}$ (SEQ ID NO: 8). In other embodiments, at least four of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$His_5$-$Tyr_6$-$Trp_7$-$Ala$-$Gln_9$-$Leu_{10}$-$X_{11}$-$Ser_{12}$ (SEQ ID NO: 8). In other embodiments, at least five of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$His_5$-$Tyr_6$-$Trp_7$-$Ala_8$-$Gln_9$-$Leu_{10}$-$X_{11}$-$Ser_{12}$ (SEQ ID NO: 8). In other embodiments, at least six of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$His_5$-$Tyr_6$-$Trp_7$-$Ala_8$-$Gln_9$-$Leu_{10}$-$X_1$-$Ser_{12}$ (SEQ ID NO: 8). In other embodiments, at least seven of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$His_5$-$Tyr_6$-$Trp_7$-$Ala_8$-$Gln_9$-$Leu_{10}$-$X_{11}$-$Ser_{12}$ (SEQ ID NO: 8).

In some embodiments, a peptidomimetic macrocycle has the Formula:

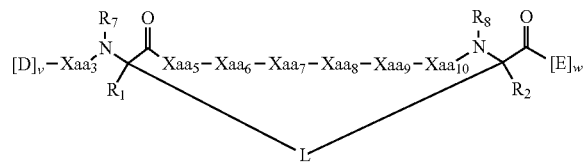

wherein:
each of $Xaa_3$, $Xaa_5$, $Xaa_6$, $Xaa_7$, $Xaa_8$, $Xaa_9$, and $Xaa_{10}$ is individually an amino acid, wherein at least three of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$Glu_5$-$Tyr_6$-$Trp_7$-$Ala_8$-$Gln_9$-$Leu_{10}$/$Cba_{10}$-$X_{11}$-Ala12 (SEQ ID NO: 9), wherein each X is an amino acid; each D is independently an amino acid;

each E is independently an amino acid, for example an amino acid selected from Ala (alanine), D-Ala (D-alanine), Aib (α-aminoisobutyric acid), Sar (N-methyl glycine), and Ser (serine); each $R_1$ and $R_2$ are independently —H, alkyl, alkenyl, alkynyl, arylalkyl, cycloalkyl, cycloalkylalkyl, heteroalkyl, or heterocycloalkyl, unsubstituted or substituted with halo-; or at least one of $R_1$ and $R_2$ forms a macrocycle-forming linker L' connected to the alpha position of one of said D or E amino acids;

each L or L' is independently a macrocycle-forming linker; each $R_5$ is independently halogen, alkyl, —$OR_6$, —$N(R_6)_2$, —$SR_6$, —$SOR_6$, —$SO_2R_6$, —$CO_2R_6$, a fluorescent moiety, a radioisotope or a therapeutic agent;

each $R_6$ is independently —H, alkyl, alkenyl, alkynyl, arylalkyl, cycloalkylalkyl, heterocycloalkyl, a fluorescent moiety, a radioisotope or a therapeutic agent;

each $R_7$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with a D residue;

each $R_8$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with an E residue;

v is an integer from 0-1000, for example, 0-500, 0-200, 0-100, 0-50, 0-30, 0-20, 0-10, 0-5, 1-1000, 1-500, 1-200, 1-100, 1-50, 1-30, 1-20, 1-10, 1-5, 3-1000, 3-500, 3-200, 3-100, 3-50, 3-30, 3-20, 3-10, 0, 1, 2, 3, 4, 5, 6, 7, 8, 9, or 10; and w is an integer from 0-1000, for example, 0-500, 0-200, 0-100, 0-50, 0-30, 0-20, 0-10, 0-5, 1-1000, 1-500, 1-200, 1-100, 1-50, 1-30, 1-20, 1-10, 1-5, 3-1000, 3-500, 3-200, 3-100, 3-50, 3-30, 3-20, 3-10, 0, 1, 2, 3, 4, 5, 6, 7, 8, 9, or 10.

In some embodiments of the above Formula, at least three of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$Glu_5$-$Tyr_6$-$Trp_7$-$Ala_8$-$Gln_9$-$Leu_{10}$/$Cba_{10}$-$X_{11}$-$Ala_{12}$ (SEQ ID NO: 9) In other embodiments of the above Formula, at least four of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$Glu_5$-$Tyr_6$-$Trp_7$-Ala-$Gln_9$-$Leu_{10}$/$Cba_{10}$-$X_{11}$-$Ala_{12}$ (SEQ ID NO: 9). In other embodiments of the above Formula, at least five of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$Glu_5$-$Tyr_6$-$Trp_7$-Ala-$Gln_9$-$Leu_{10}$/$Cba_{10}$-$X_1$-$Ala_{12}$ (SEQ ID NO: 9) In other embodiments of the above Formula, at least six of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$Glu_5$-$Tyr_6$-$Trp_7$-$Ala_8$-$Gln_9$-$Leu_{10}$/$Cba_{10}$-$X_1$-$Ala_{12}$ (SEQ ID NO: 9) In other embodiments of the above Formula, at least seven of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$Glu_5$-$Tyr_6$-$Trp_7$-$Ala_8$-$Gln_9$-$Leu_{10}$/$Cba_{10}$-$X_1$-$Ala_{12}$ (SEQ ID NO: 9).

In some embodiments, w is an integer from 3-10, for example 3-6, 3-8, 6-8, or 6-10. In some embodiments, w is 3. In other embodiments, w is 6. In some embodiments, v is an integer from 1-10, for example 2-5. In some embodiments, v is 2.

In an embodiment of any of the Formulas described herein, of the macrocycle-forming linker (L) has a formula-$L_1$-$L_2$-, wherein $L_1$ and $L_2$ are independently alkylene, alkenylene, alkynylene, heteroalkylene, cycloalkylene, heterocycloalkylene, cycloarylene, heterocycloarylene, or [—$R_4$—K—$R_4$-]$_n$, each being optionally substituted with $R_5$;

each $R_4$ is independently alkylene, alkenylene, alkynylene, heteroalkylene, cycloalkylene, heterocycloalkylene, arylene, or heteroarylene;

each K is independently O, S, SO, $SO_2$, CO, $CO_2$, or $CONR_3$;

each $R_3$ is independently hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with $R_5$;

and n is an integer from 1-5.

In some embodiments in the Formulas described herein, L (or L') is a macrocycle-forming linker of the formula

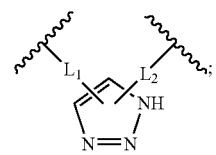

Exemplary embodiments of such macrocycle-forming linkers L are shown below.

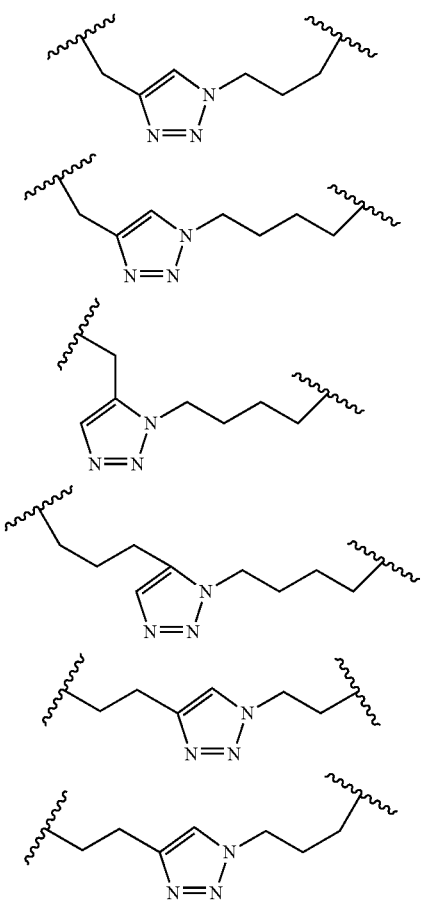

63
-continued
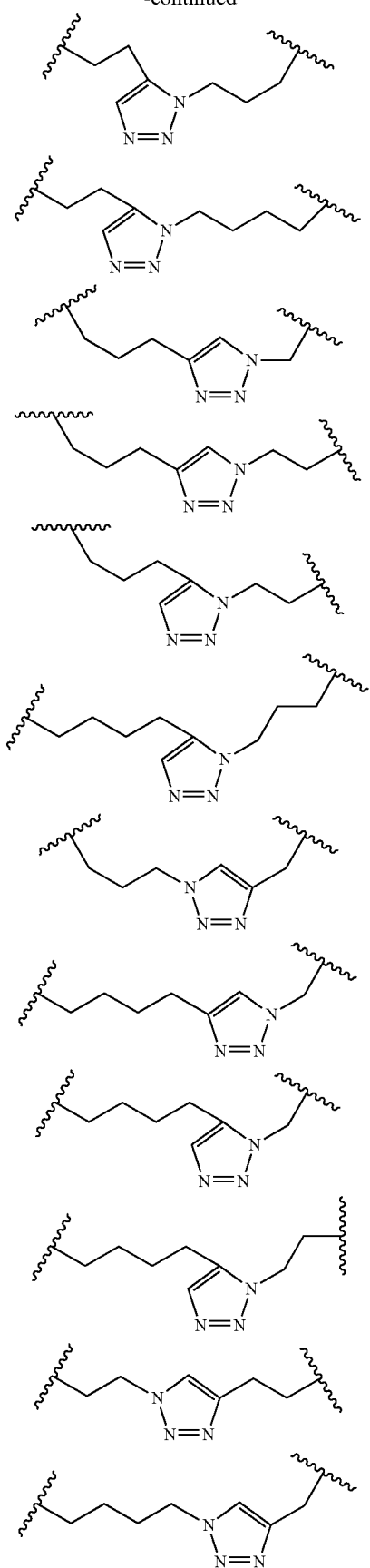
64
-continued
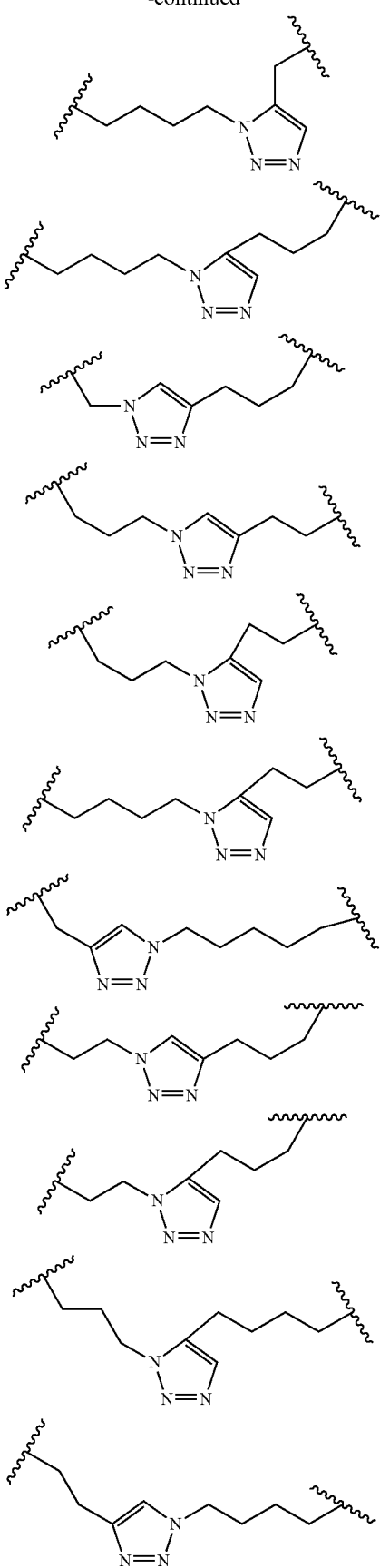

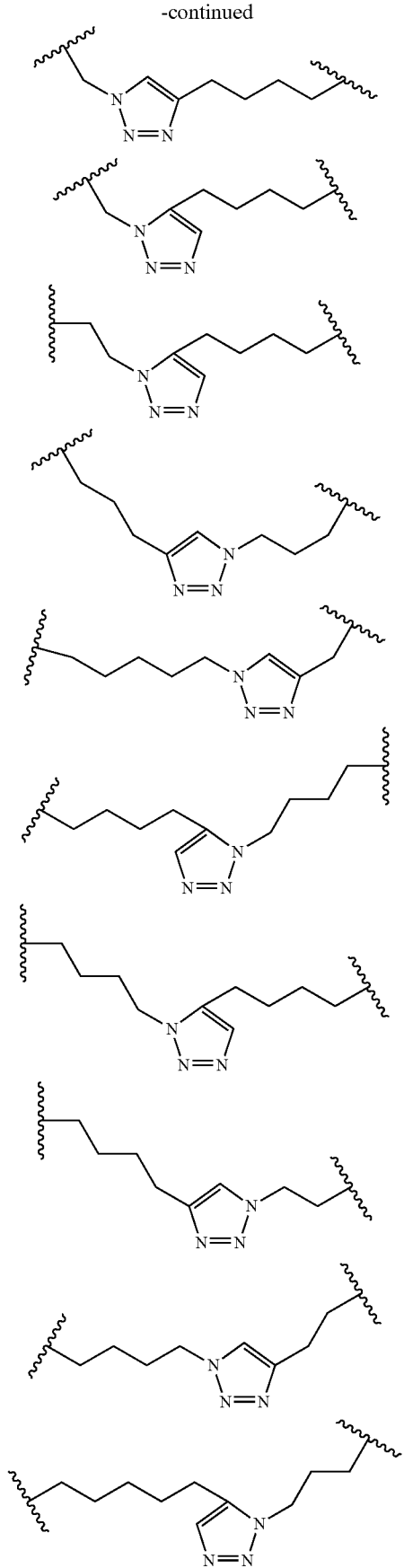
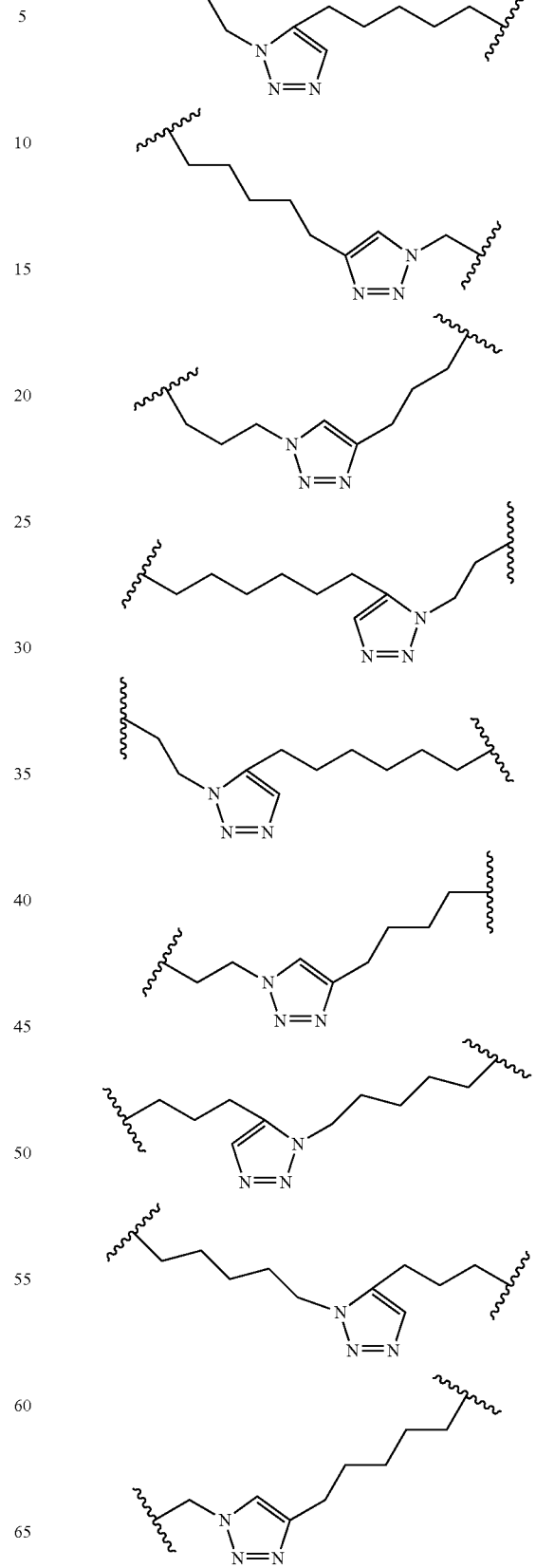

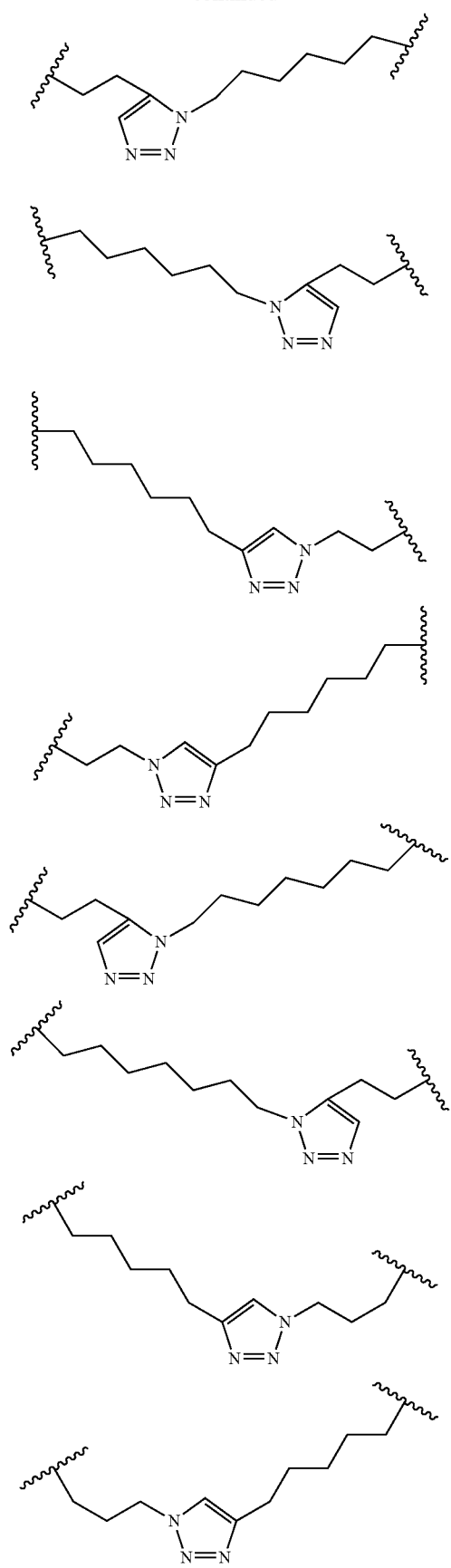
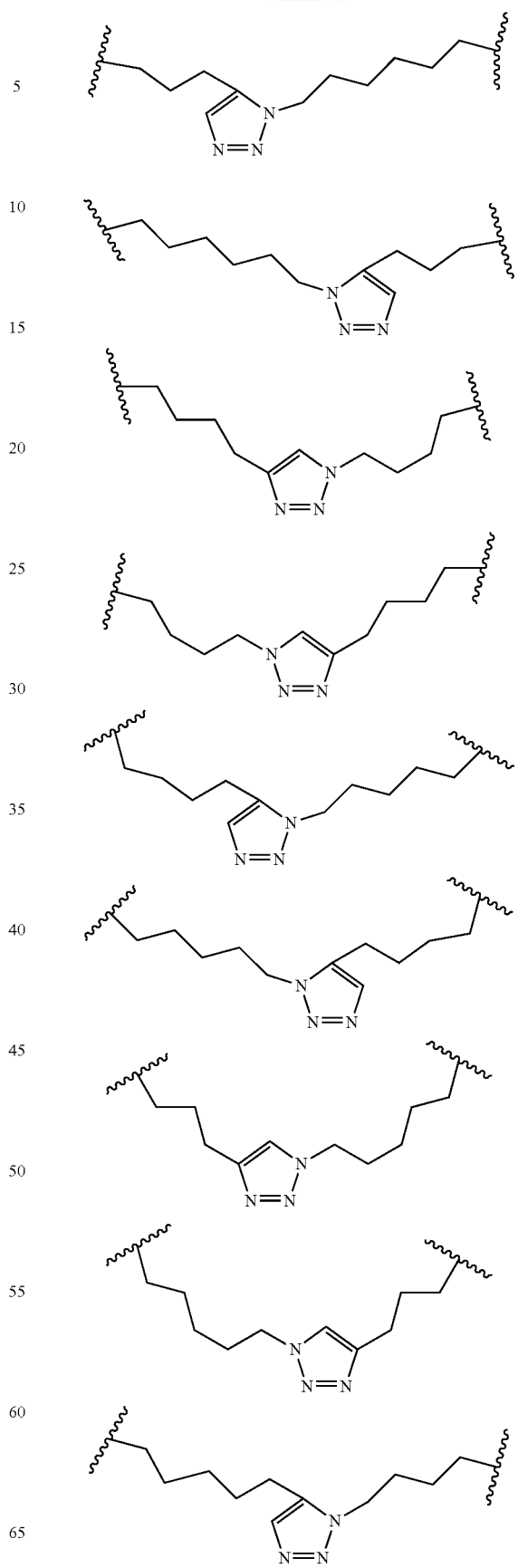

69
-continued
70
-continued
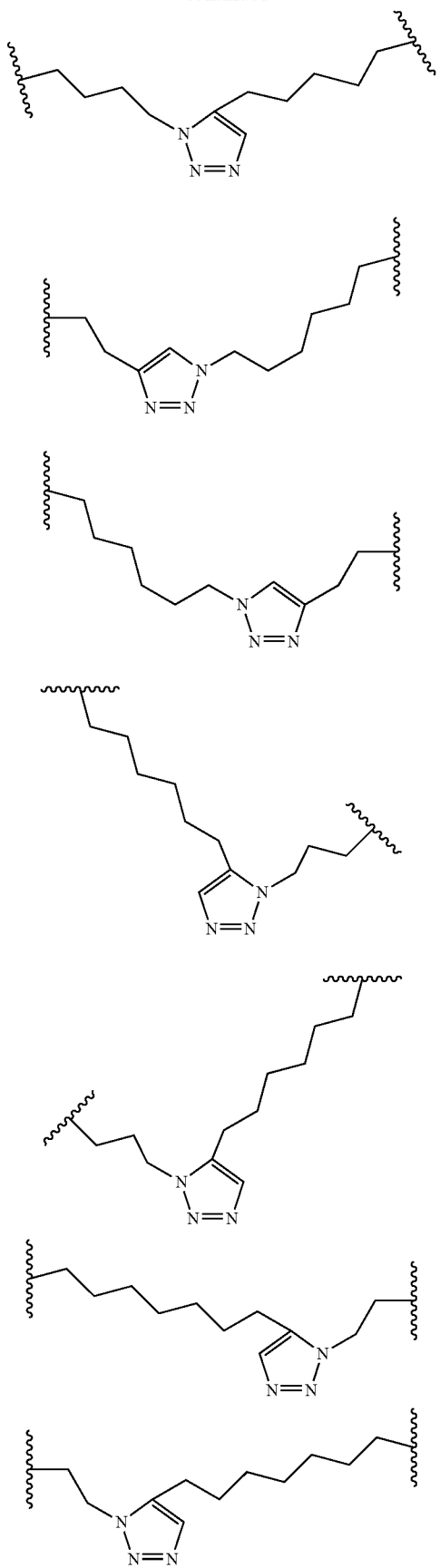
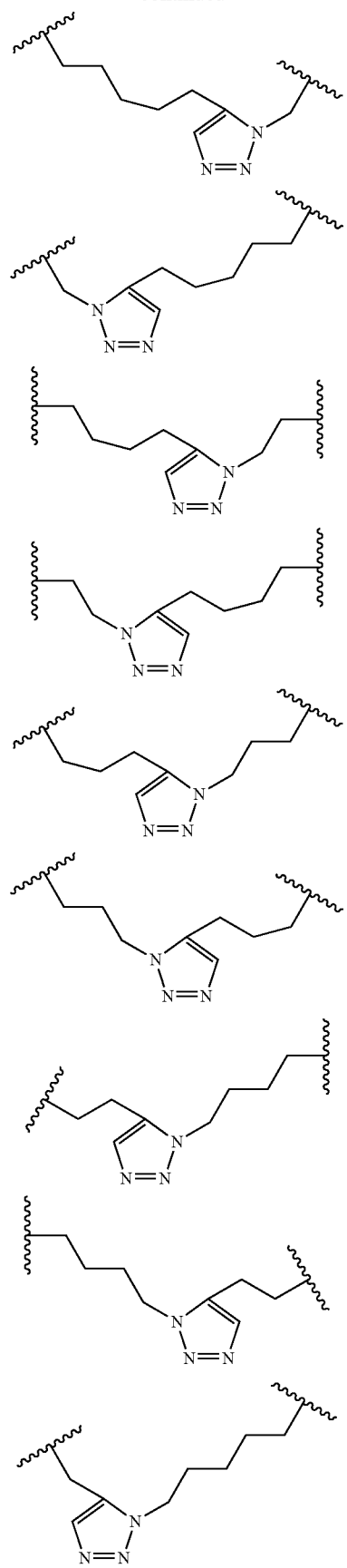

-continued

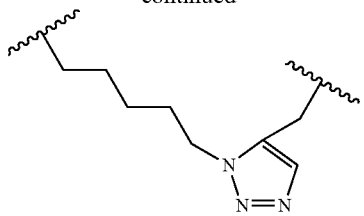

In an embodiment of any of the Formulas described herein, $L_1$ and $L_2$, either alone or in combination, form a triazole or a thioether.

In an embodiment of any of the Formulas described herein, $L_1$ and $L_2$, either alone or in combination, do not form a triazole or a thioether.

In one example, at least one of $R_1$ and $R_2$ is alkyl, unsubstituted or substituted with halo-. In another example, both $R_1$ and $R_2$ are independently alkyl, unsubstituted or substituted with halo-. In some embodiments, at least one of $R_1$ and $R_2$ is methyl. In other embodiments, $R_1$ and $R_2$ are methyl.

In some embodiments, x+y+z is at least 3. In other embodiments, x+y+z is 1, 2, 3, 4, 5, 6, 7, 8, 9 or 10. In some embodiments, the sum of x+y+z is 3 or 6. In some embodiments, the sum of x+y+z is 3. In other embodiments, the sum of x+y+z is 6. Each occurrence of A, B, C, D or E in a macrocycle or macrocycle precursor is independently selected. For example, a sequence represented by the formula $[A]_x$, when x is 3, encompasses embodiments where the amino acids are not identical, e.g. Gln-Asp-Ala as well as embodiments where the amino acids are identical, e.g. Gln-Gln-Gln. This applies for any value of x, y, or z in the indicated ranges. Similarly, when u is greater than 1, each compound can encompass peptidomimetic macrocycles which are the same or different. For example, a compound can comprise peptidomimetic macrocycles comprising different linker lengths or chemical compositions.

In some embodiments, the peptidomimetic macrocycle comprises a secondary structure which is an α-helix and $R_8$ is —H, allowing intrahelical hydrogen bonding. In some embodiments, at least one of A, B, C, D or E is an α,α-disubstituted amino acid. In one example, B is an α,α-disubstituted amino acid. For instance, at least one of A, B, C, D or E is 2-aminoisobutyric acid. In other embodiments, at least one of A, B, C, D or E is

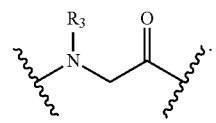

In other embodiments, the length of the macrocycle-forming linker L as measured from a first Cα to a second Cα is selected to stabilize a desired secondary peptide structure, such as an α-helix formed by residues of the peptidomimetic macrocycle including, but not necessarily limited to, those between the first Cα to a second Cα.

In one embodiment, the peptidomimetic macrocycle of Formula (I) is:

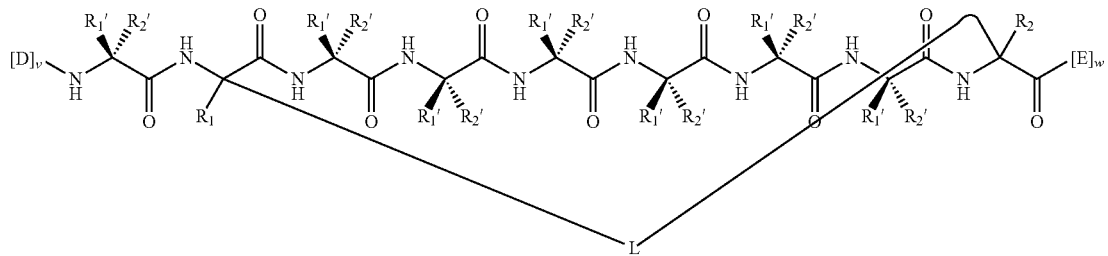

wherein each $R_1$ and $R_2$ is independently independently —H, alkyl, alkenyl, alkynyl, arylalkyl, cycloalkyl, cycloalkylalkyl, heteroalkyl, or heterocycloalkyl, unsubstituted or substituted with halo-.

In related embodiments, the peptidomimetic macrocycle of Formula (I) is:

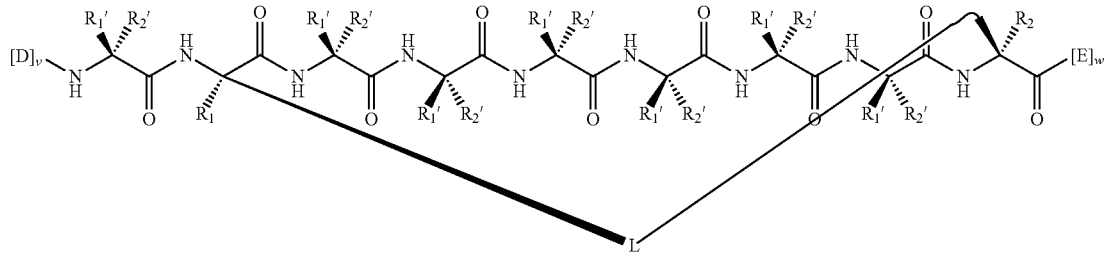

wherein each $R_1'$ and $R_2'$ is independently an amino acid.

In other embodiments, the peptidomimetic macrocycle of Formula (I) is a compound of any of the formulas shown below:

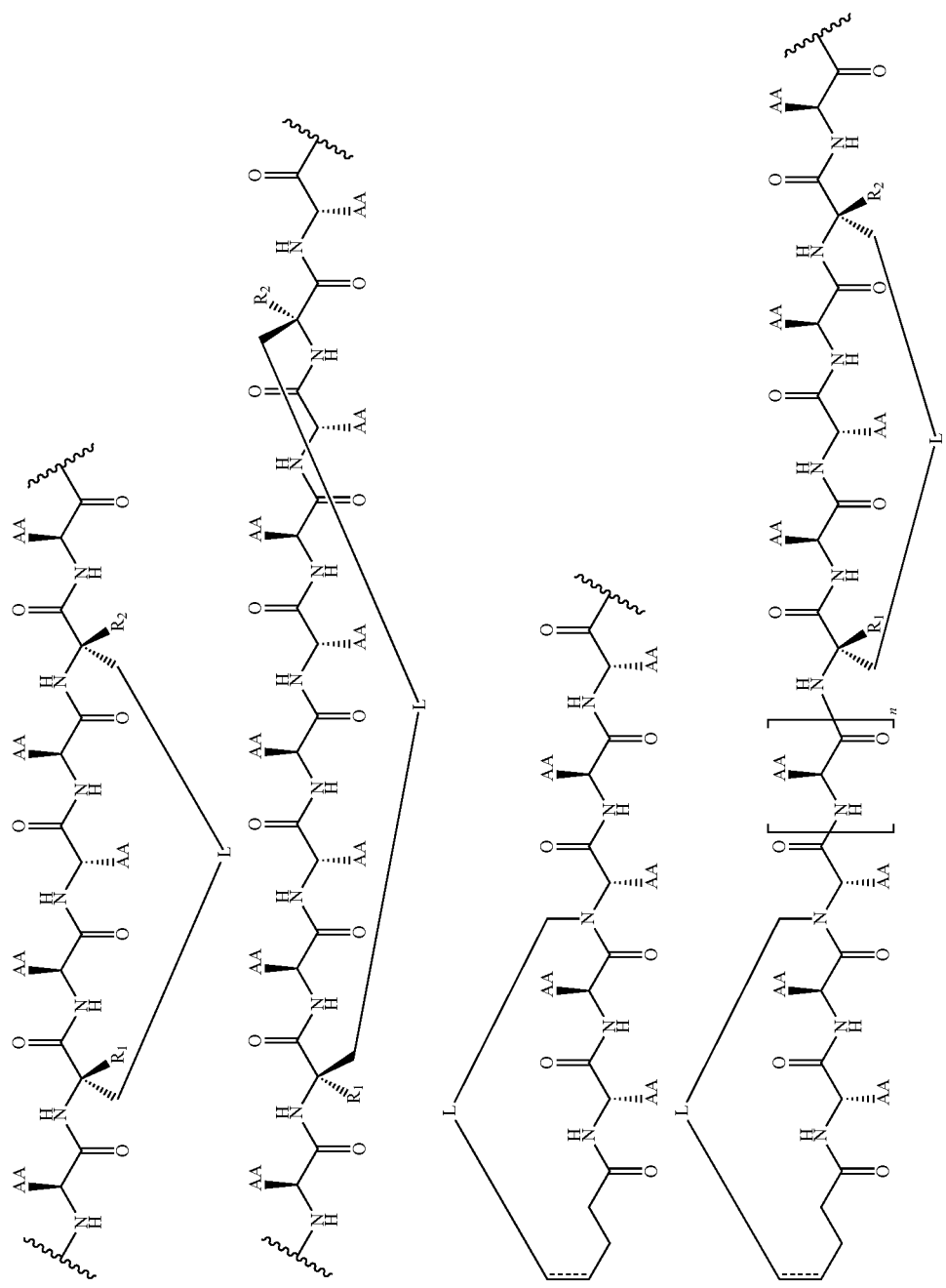

-continued
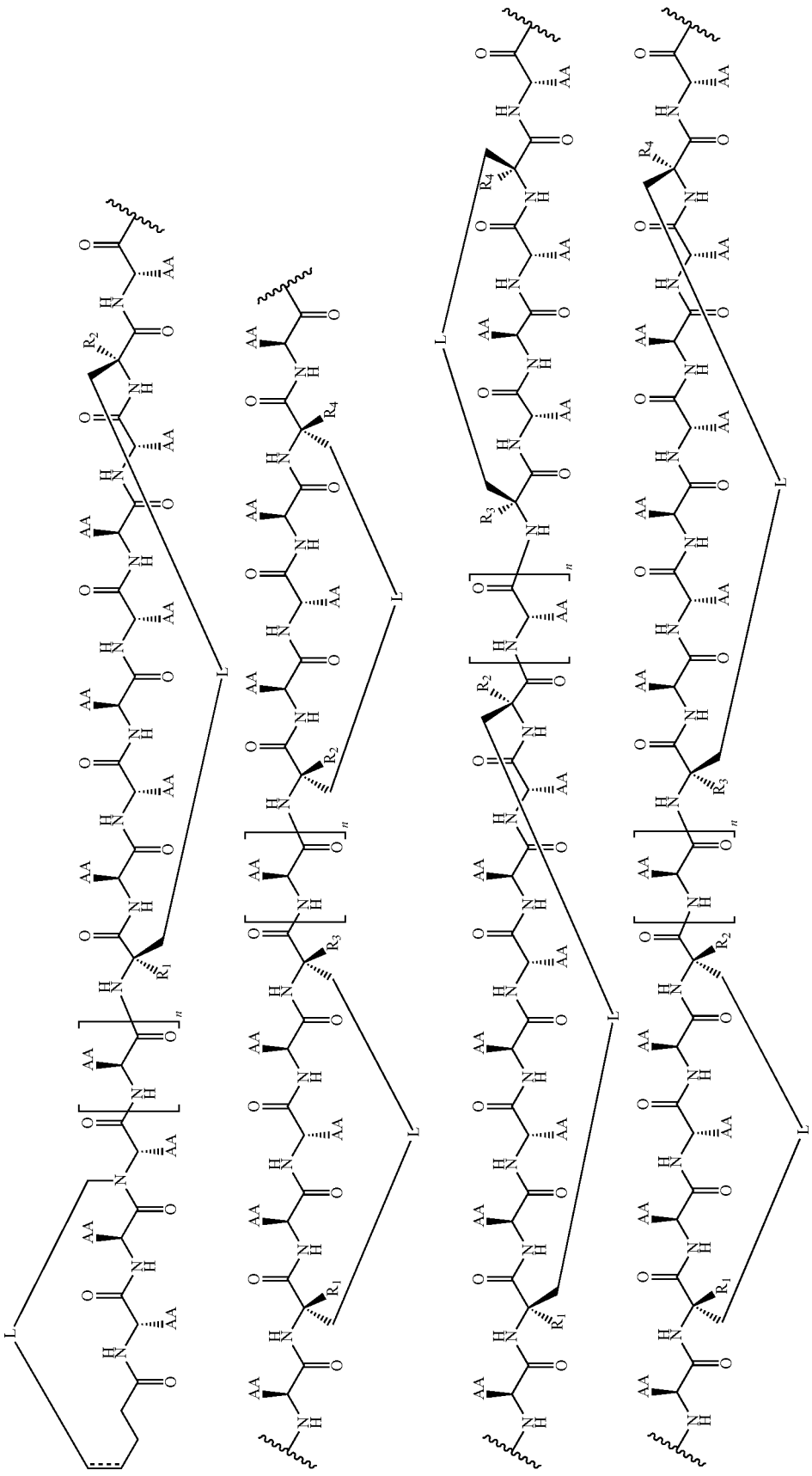

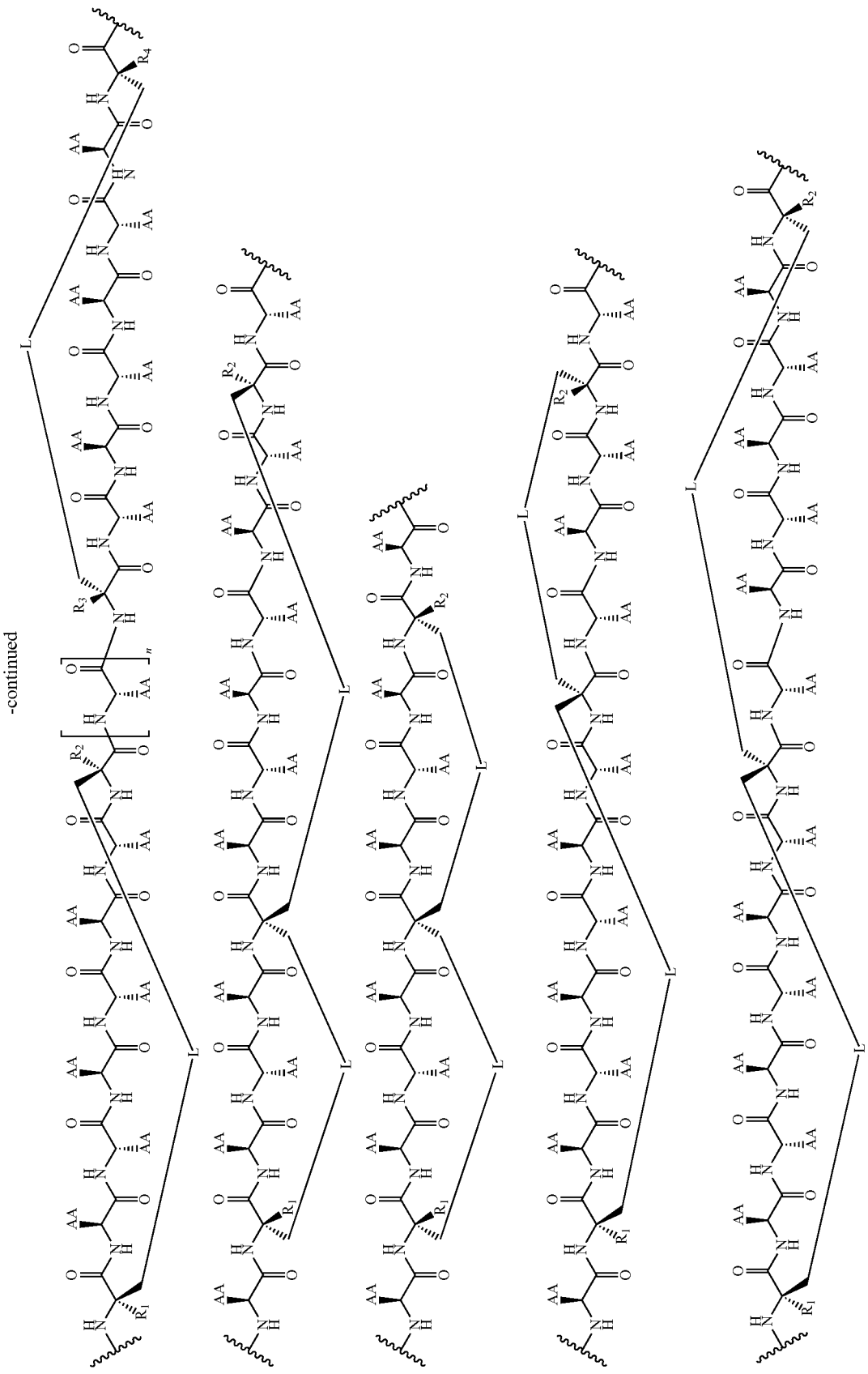

wherein "AA" represents any natural or non-natural amino acid side chain and "⸺" is [D]$_v$, [E]$_w$ as defined above, and n is an integer between 0 and 20, 50, 100, 200, 300, 400 or 500. In some embodiments, n is 0. In other embodiments, n is less than 50.

Exemplary embodiments of the macrocycle-forming linker L are shown below.

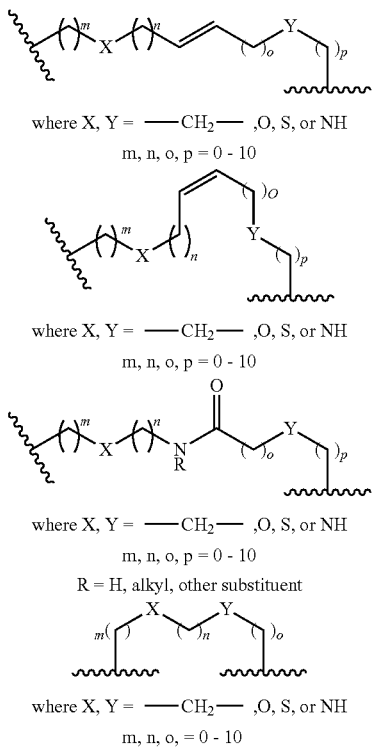

where X, Y = ⸺CH$_2$⸺ ,O, S, or NH
m, n, o, p = 0 - 10 where X, Y = ⸺CH$_2$⸺ ,O, S, or NH
m, n, o, p = 0 - 10 where X, Y = ⸺CH$_2$⸺ ,O, S, or NH
m, n, o, p = 0 - 10
R = H, alkyl, other substituent where X, Y = ⸺CH$_2$⸺ ,O, S, or NH
m, n, o, = 0 - 10

In other embodiments, D and/or E in the compound of Formula I are further modified in order to facilitate cellular uptake. In some embodiments, lipidating or PEGylating a peptidomimetic macrocycle facilitates cellular uptake, increases bioavailability, increases blood circulation, alters pharmacokinetics, decreases immunogenicity and/or decreases the needed frequency of administration.

In other embodiments, at least one of [D] and [E] in the compound of Formula I represents a moiety comprising an additional macrocycle-forming linker such that the peptidomimetic macrocycle comprises at least two macrocycle-forming linkers. In a specific embodiment, a peptidomimetic macrocycle comprises two macrocycle-forming linkers. In an embodiment, u is 2.

In some embodiments, any of the macrocycle-forming linkers described herein can be used in any combination with any of the sequences shown in Table 3, Table 3a, Table 3b, or Table 3c and also with any of the R— substituents indicated herein.

In some embodiments, the peptidomimetic macrocycle comprises at least one α-helix motif. For example, A, B and/or C in the compound of Formula I include one or more α-helices. As a general matter, α-helices include between 3 and 4 amino acid residues per turn. In some embodiments, the α-helix of the peptidomimetic macrocycle includes 1 to 5 turns and, therefore, 3 to 20 amino acid residues. In specific embodiments, the α-helix includes 1 turn, 2 turns, 3 turns, 4 turns, or 5 turns. In some embodiments, the macrocycle-forming linker stabilizes an α-helix motif included within the peptidomimetic macrocycle. Thus, in some embodiments, the length of the macrocycle-forming linker L from a first Cα to a second Cα is selected to increase the stability of an α-helix. In some embodiments, the macrocycle-forming linker spans from 1 turn to 5 turns of the α-helix. In some embodiments, the macrocycle-forming linker spans approximately 1 turn, 2 turns, 3 turns, 4 turns, or 5 turns of the α-helix. In some embodiments, the length of the macrocycle-forming linker is approximately 5 Å to 9 Å per turn of the α-helix, or approximately 6 Å to 8 Å per turn of the α-helix. Where the macrocycle-forming linker spans approximately 1 turn of an α-helix, the length is equal to approximately 5 carbon-carbon bonds to 13 carbon-carbon bonds, approximately 7 carbon-carbon bonds to 11 carbon-carbon bonds, or approximately 9 carbon-carbon bonds. Where the macrocycle-forming linker spans approximately 2 turns of an α-helix, the length is equal to approximately 8 carbon-carbon bonds to 16 carbon-carbon bonds, approximately 10 carbon-carbon bonds to 14 carbon-carbon bonds, or approximately 12 carbon-carbon bonds. Where the macrocycle-forming linker spans approximately 3 turns of an α-helix, the length is equal to approximately 14 carbon-carbon bonds to 22 carbon-carbon bonds, approximately 16 carbon-carbon bonds to 20 carbon-carbon bonds, or approximately 18 carbon-carbon bonds. Where the macrocycle-forming linker spans approximately 4 turns of an α-helix, the length is equal to approximately 20 carbon-carbon bonds to 28 carbon-carbon bonds, approximately 22 carbon-carbon bonds to 26 carbon-carbon bonds, or approximately 24 carbon-carbon bonds. Where the macrocycle-forming linker spans approximately 5 turns of an α-helix, the length is equal to approximately 26 carbon-carbon bonds to 34 carbon-carbon bonds, approximately 28 carbon-carbon bonds to 32 carbon-carbon bonds, or approximately 30 carbon-carbon bonds. Where the macrocycle-forming linker spans approximately 1 turn of an α-helix, the linkage contains approximately 4 atoms to 12 atoms, approximately 6 atoms to 10 atoms, or approximately 8 atoms. Where the macrocycle-forming linker spans approximately 2 turns of the α-helix, the linkage contains approximately 7 atoms to 15 atoms, approximately 9 atoms to 13 atoms, or approximately 11 atoms. Where the macrocycle-forming linker spans approximately 3 turns of the α-helix, the linkage contains approximately 13 atoms to 21 atoms, approximately 15 atoms to 19 atoms, or approximately 17 atoms. Where the macrocycle-forming linker spans approximately 4 turns of the α-helix, the linkage contains approximately 19 atoms to 27 atoms, approximately 21 atoms to 25 atoms, or approximately 23 atoms. Where the macrocycle-forming linker spans approximately 5 turns of the α-helix, the linkage contains approximately 25 atoms to 33 atoms, approximately 27 atoms to 31 atoms, or approximately 29 atoms. Where the macrocycle-forming linker spans approximately 1 turn of the α-helix, the resulting macrocycle forms a ring containing approximately 17 members to 25 members, approximately 19 members to 23 members, or approximately 21 members. Where the macrocycle-forming linker spans approximately 2 turns of the α-helix, the resulting macrocycle forms a ring containing approximately 29 members to 37 members, approximately 31 members to 35 members, or approximately 33 members. Where the macrocycle-forming linker spans approximately 3 turns of the α-helix, the resulting macrocycle forms a ring containing approximately 44 members to 52 members, approximately 46 members to 50 members, or approximately 48 members.

Where the macrocycle-forming linker spans approximately 4 turns of the α-helix, the resulting macrocycle forms a ring containing approximately 59 members to 67 members, approximately 61 members to 65 members, or approximately 63 members. Where the macrocycle-forming linker spans approximately 5 turns of the α-helix, the resulting macrocycle forms a ring containing approximately 74 members to 82 members, approximately 76 members to 80 members, or approximately 78 members.

In other embodiments, provided are peptidomimetic macrocycles of Formula (IV) or (IVa):

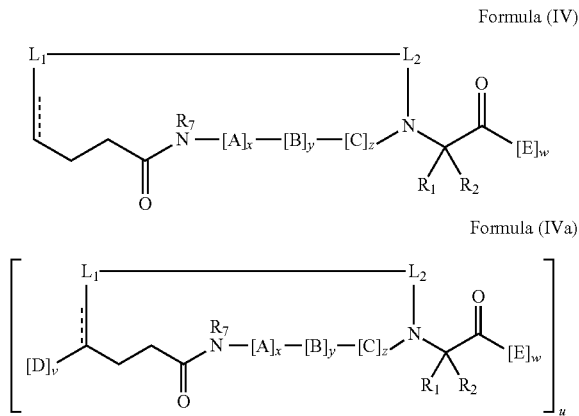

Formula (IV)

Formula (IVa)

wherein:
each A, C, D, and E is independently a natural or non-natural amino acid, and the terminal D and E independently optionally include a capping group; B is a natural or non-natural amino acid, amino acid analog,

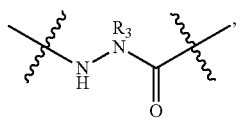

[—NH-$L_3$-CO—], [—NH-$L_3$-$SO_2$—], or [—NH-$L_3$-];
$R_1$ and $R_2$ are independently —H, alkyl, alkenyl, alkynyl, arylalkyl, cycloalkyl, cycloalkylalkyl, heteroalkyl, or heterocycloalkyl, unsubstituted or substituted with halo-; or at least one of $R_1$ and $R_2$ forms a macrocycle-forming linker L' connected to the alpha position of one of said D or E amino acids;
$R_3$ is hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with $R_5$;
L is a macrocycle-forming linker of the formula-$L_1$-$L_2$-;
$L_1$, $L_2$ and $L_3$ are independently alkylene, alkenylene, alkynylene, heteroalkylene, cycloalkylene, heterocycloalkylene, cycloarylene, heterocycloarylene, or [—$R_4$—K—$R_4$-]$_n$, each being optionally substituted with $R_5$;
each $R_4$ is alkylene, alkenylene, alkynylene, heteroalkylene, cycloalkylene, heterocycloalkylene, arylene, or heteroarylene;
each K is O, S, SO, $SO_2$, CO, $CO_2$, or $CONR_3$;
each $R_5$ is independently halogen, alkyl, —$OR_6$, —$N(R_6)_2$, —$SR_6$, —$SOR_6$, —$SO_2R_6$, —$CO_2R_6$, a fluorescent moiety, a radioisotope or a therapeutic agent;
each $R_6$ is independently —H, alkyl, alkenyl, alkynyl, arylalkyl, cycloalkylalkyl, heterocycloalkyl, a fluorescent moiety, a radioisotope or a therapeutic agent;

$R_7$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$;
v and w are independently integers from 1-1000;
u is an integer from 1-10;
x, y and z are independently integers from 0-10; and
n is an integer from 1-5.

In one example, $L_1$ and $L_2$, either alone or in combination, do not form a triazole or a thioether.

In one example, at least one of $R_1$ and $R_2$ is alkyl, unsubstituted or substituted with halo-. In another example, both $R_1$ and $R_2$ are independently alkyl, unsubstituted or substituted with halo-. In some embodiments, at least one of $R_1$ and $R_2$ is methyl. In other embodiments, $R_1$ and $R_2$ are methyl.

In some embodiments, x+y+z is at least 1. In other embodiments, x+y+z is at least 2. In other embodiments, x+y+z is 1, 2, 3, 4, 5, 6, 7, 8, 9 or 10. Each occurrence of A, B, C, D or E in a macrocycle or macrocycle precursor is independently selected. For example, a sequence represented by the formula [A]x, when x is 3, encompasses embodiments where the amino acids are not identical, e.g. Gln-Asp-Ala as well as embodiments where the amino acids are identical, e.g. Gln-Gln-Gln. This applies for any value of x, y, or z in the indicated ranges.

In some embodiments, the peptidomimetic macrocycle comprises a secondary structure which is an α-helix and $R_8$ is —H, allowing intrahelical hydrogen bonding. In some embodiments, at least one of A, B, C, D or E is an α,α-disubstituted amino acid. In one example, B is an α,α-disubstituted amino acid. For instance, at least one of A, B, C, D or E is 2-aminoisobutyric acid. In other embodiments, at least one of A, B, C, D or E is

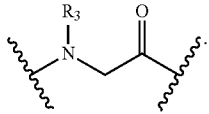

In other embodiments, the length of the macrocycle-forming linker L as measured from a first Cα to a second Cα is selected to stabilize a desired secondary peptide structure, such as an α-helix formed by residues of the peptidomimetic macrocycle including, but not necessarily limited to, those between the first Cα to a second Cα.

Exemplary embodiments of the macrocycle-forming linker-$L_1$-$L_2$-are shown below.

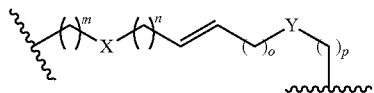

where X, Y = —$CH_2$—, O, S, or NH m, n, o, p = 0 - 10

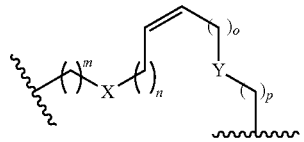

where X, Y = —$CH_2$—, O, S, or NH m, n, o, p = 0 - 10

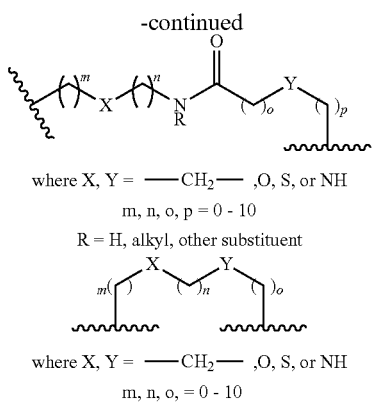

where X, Y = —CH$_2$— ,O, S, or NH m, n, o, p = 0 - 10

R = H, alkyl, other substituent where X, Y = —CH$_2$— ,O, S, or NH m, n, o, = 0 - 10

Unless otherwise stated, any compounds (including peptidomimetic macrocycles, macrocycle precursors, and other compositions) are also meant to encompass compounds which differ only in the presence of one or more isotopically enriched atoms. For example, compounds having the described structures except for the replacement of a hydrogen by a deuterium or tritium, or the replacement of a carbon by $^{13}$C- or $^{14}$C-enriched carbon are within the scope of this disclosure.

In some embodiments, the compounds disclosed herein can contain unnatural proportions of atomic isotopes at one or more of atoms that constitute such compounds. For example, the compounds can be radiolabeled with radioactive isotopes, such as for example tritium ($^3$H), iodine-125 ($^{125}$I) or carbon-14 ($^{14}$C). In other embodiments, one or more carbon atoms is replaced with a silicon atom. All isotopic variations of the compounds disclosed herein, whether radioactive or not, are contemplated herein.

The circulating half-life of the peptidomimetic macrocycles in human blood can be about 1-24 h. For example the circulating half-life of the peptidomimetic macrocycles in human blood can me about 2-24 h, 4-24 h, 6-24 h, 8-24 h, 10-24 h, 12-24 h, 14-24 h, 16-24 h, 18-24 h, 20-24 h, 22-24 h, 1-20 h, 4-20 h, 6-20 h, 8-20 h, 10-20 h, 12-20 h, 14-20 h, 16-20 h, 18-20 h, 1-16 h, 4-16 h, 6-16 h, 8-16 h, 10-16 h, 12-16 h, 14-16 h, 1-12 h, 4-12 h, 6-12 h, 8-12 h, 10-12 h, 1-8 h, 4-8 h, 6-8 h, or 1-4 h. In some examples, the circulating half-life of the peptidomimetic macrocycles in human blood can be bout 1-12 h, for example about 1 h, 2 h, 3 h, 4 h, 5 h, 6 h, 7 h, 8 h, 9 h, 10 h, 11 h, or 12 h. In some examples, the circulating half-life of the peptidomimetic macrocycles in human blood is about 2 h. In some examples, the circulating half-life of the peptidomimetic macrocycles in human blood is about 4 h. In some examples, the circulating half-life of the peptidomimetic macrocycles in human blood is about 6 h. In some examples, the circulating half-life of the peptidomimetic macrocycles in human blood is about 8 h. In some examples, the circulating half-life of the peptidomimetic macrocycles in human blood is about 10 h.

The half-life of the peptidomimetic macrocycles in biological tissue can be about 1-24 h. For example the circulating half-life of the peptidomimetic macrocycles in human blood can me about 1-24 h, 5-24 h, 10-24 h, 15-24 h, 20-24 h, 1-22 h, 5-22 h, 10-22 h, 15-22 h, 20-22 h, 1-20 h, 5-20 h, 15-20 h, 1-18 h, 5-18 h, 10-18 h, 15-18 h, 1-16 h, 5-16 h, 10-16 h, 15-16 h, 1-14 h, 5-14 h, 10-14 h, 1-12 h, 5-12 h, 10-12 h, 1-10 h, 5-10h, 1-8 h, 5-8 h, 1-6 h, 5-6h, or 1-4 h. In some examples, the circulating half-life of the peptidomimetic macrocycles in human blood can be bout 5-20 h, for example about 5 h, 6 h, 7 h, 8 h, 9 h, 10 h, 11 h, 12 h, 13 h, 14 h, 15 h, 16 h, 17 h, 18 h, 19 h or 20 h. In some examples, the circulating half-life of the peptidomimetic macrocycles in human blood is about 2 h. In some examples, the circulating half-life of the peptidomimetic macrocycles in human blood is about 4 h. In some examples, the circulating half-life of the peptidomimetic macrocycles in human blood is about 6 h. In some examples, the circulating half-life of the peptidomimetic macrocycles in human blood is about 8 h. In some examples, the circulating half-life of the peptidomimetic macrocycles in human blood is about 10 h.

The circulating half-life of the peptidomimetic macrocycles in human blood can be greater than, equal to, or less than the half-life of the peptidomimetic macrocycles in biological tissue. In some examples, the circulating half-life of the peptidomimetic macrocycles in human blood can be greater than the half-life of the peptidomimetic macrocycles in biological tissue. In some examples, the circulating half-life of the peptidomimetic macrocycles in human blood can be equal to the half-life of the peptidomimetic macrocycles in biological tissue. In some examples, the half-life of the peptidomimetic macrocycles in biological tissue is greater than the circulating half-life of the peptidomimetic macrocycles in human blood. This can facilitate administration of the peptidomimetic macrocycles at a lower dose and/or at lower frequency. In some embodiments, the half-life of the peptidomimetic macrocycles in biological tissue is at least 1 h, at least 2 h, at least 3 h, at least 4 h, at least 5 h, at least 6 h, at least 7 h, at least 8 h, at least 9 h, at least 10 h, at least 11 h, or at least 12 h greater than the than the circulating half-life of the peptidomimetic macrocycles in human blood. In some examples, the circulating half-life of the peptidomimetic macrocycles in human blood is about 4 h and the half-life of the in biological tissue is about 10 h. In some examples, the circulating half-life of the peptidomimetic macrocycles in human blood is about 6 h and the half-life of the in biological tissue is about 10 h.

Preparation of Peptidomimetic Macrocycles

Peptidomimetic macrocycles can be prepared by any of a variety of methods known in the art. For example, any of the residues indicated by "$" or "$r8" in Table 3, Table 3a, Table 3b, or Table 3c can be substituted with a residue capable of forming a crosslinker with a second residue in the same molecule or a precursor of such a residue.

Various methods to effect formation of peptidomimetic macrocycles are known in the art. For example, the preparation of peptidomimetic macrocycles of Formula I is described in Schafmeister et al., J. Am. Chem. Soc. 122: 5891-5892 (2000); Schafmeister & Verdine, J. Am. Chem. Soc. 122:5891 (2005); Walensky et al., Science 305:1466-1470 (2004); U.S. Pat. No. 7,192,713 and PCT application WO 2008/121767. The α,α-disubstituted amino acids and amino acid precursors disclosed in the cited references can be employed in synthesis of the peptidomimetic macrocycle precursor polypeptides. For example, the "S5-olefin amino acid" is (S)-α-(2'-pentenyl) alanine and the "R$_8$ olefin amino acid" is (R)-α-(2'-octenyl) alanine.

Following incorporation of such amino acids into precursor polypeptides, the terminal olefins are reacted with a metathesis catalyst, leading to the formation of the peptidomimetic macrocycle. In various embodiments, the following amino acids can be employed in the synthesis of the peptidomimetic macrocycle:

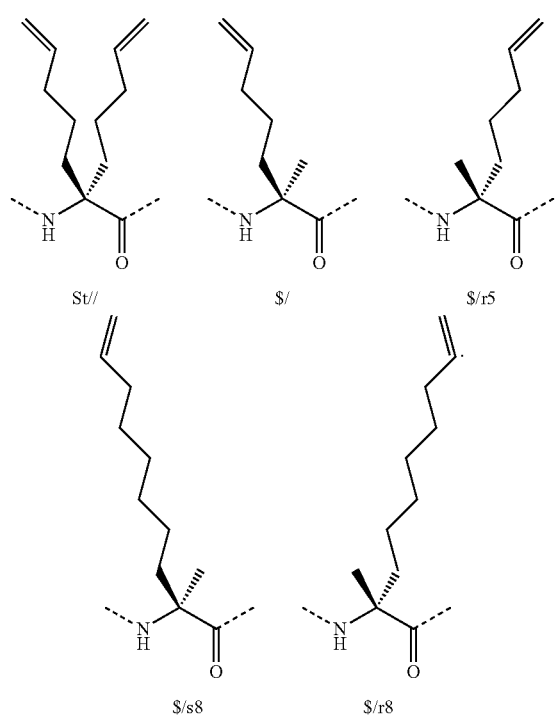

In other embodiments, the peptidomimetic macrocycles are of Formula IV or IVa. Methods for the preparation of such macrocycles are described, for example, in U.S. Pat. No. 7,202,332.

Additional methods of forming peptidomimetic macrocycles which are envisioned as suitable include those disclosed by Mustapa, M. Firouz Mohd et al., J. Org. Chem (2003), 68, pp. 8193-8198; Yang, Bin et al. Bioorg Med. Chem. Lett. (2004), 14, pp. 1403-1406; U.S. Pat. Nos. 5,364,851; 5,446,128; 5,824,483; 6,713,280; and 7,202,332. In such embodiments, amino acid precursors are used containing an additional substituent R— at the alpha position. Such amino acids are incorporated into the macrocycle precursor at the desired positions, which can be at the positions where the crosslinker is substituted or, alternatively, elsewhere in the sequence of the macrocycle precursor. Cyclization of the precursor is then effected according to the indicated method.

Assays

The properties of peptidomimetic macrocycles are assayed, for example, by using the methods described below. In some embodiments, a peptidomimetic macrocycle has improved biological properties relative to a corresponding polypeptide lacking the substituents described herein.

Assay to Determine α-Helicity

In solution, the secondary structure of polypeptides with α-helical domains will reach a dynamic equilibrium between random coil structures and α-helical structures, often expressed as a "percent helicity". Thus, for example, alpha-helical domains are predominantly random coils in solution, with α-helical content usually under 25%. Peptidomimetic macrocycles with optimized linkers, on the other hand, possess, for example, an alpha-helicity that is at least two-fold greater than that of a corresponding uncrosslinked polypeptide. In some embodiments, macrocycles will possess an alpha-helicity of greater than 50%. To assay the helicity of peptidomimetic macrocycles, the compounds are dissolved in an aqueous solution (e.g. 50 mM potassium phosphate solution at pH 7, or distilled $H_2O$, to concentrations of 25-50 µM). Circular dichroism (CD) spectra are obtained on a spectropolarimeter (e.g., Jasco J-710) using standard measurement parameters (e.g. temperature, 20° C.; wavelength, 190-260 nm; step resolution, 0.5 nm; speed, 20 nm/sec; accumulations, 10; response, 1 sec; bandwidth, 1 nm; path length, 0.1 cm). The α-helical content of each peptide is calculated by dividing the mean residue ellipticity (e.g. [Φ]222obs) by the reported value for a model helical decapeptide (Yang et al. (1986), Methods Enzymol. 130: 208)).

Assay to Determine Melting Temperature (Tm)

A peptidomimetic macrocycle comprising a secondary structure such as an α-helix exhibits, for example, a higher melting temperature than a corresponding uncrosslinked polypeptide. Typically peptidomimetic macrocycles exhibit Tm of >60° C. representing a highly stable structure in aqueous solutions. To assay the effect of macrocycle formation on melting temperature, peptidomimetic macrocycles or unmodified peptides are dissolved in distilled $H_2O$ (e.g. at a final concentration of 50 µM) and the Tm is determined by measuring the change in ellipticity over a temperature range (e.g. 4 to 95° C.) on a spectropolarimeter (e.g., Jasco J-710) using standard parameters (e.g. wavelength 222 nm; step resolution, 0.5 nm; speed, 20 nm/sec; accumulations, 10; response, 1 sec; bandwidth, 1 nm; temperature increase rate: 1° C./min; path length, 0.1 cm).

Protease Resistance Assay

The amide bond of the peptide backbone is susceptible to hydrolysis by proteases, thereby rendering peptidic compounds vulnerable to rapid degradation in vivo. Peptide helix formation, however, typically buries the amide backbone and therefore can shield it from proteolytic cleavage. The peptidomimetic macrocycles can be subjected to in vitro trypsin proteolysis to assess for any change in degradation rate compared to a corresponding uncrosslinked polypeptide. For example, the peptidomimetic macrocycle and a corresponding uncrosslinked polypeptide are incubated with trypsin agarose and the reactions quenched at various time points by centrifugation and subsequent HPLC injection to quantitate the residual substrate by ultraviolet absorption at 280 nm. Briefly, the peptidomimetic macrocycle and peptidomimetic precursor (5 mcg) are incubated with trypsin agarose (Pierce) (S/E-125) for 0, 10, 20, 90, and 180 minutes. Reactions are quenched by tabletop centrifugation at high speed; remaining substrate in the isolated supernatant is quantified by HPLC-based peak detection at 280 nm. The proteolytic reaction displays first order kinetics and the rate constant, k, is determined from a plot of ln[S] versus time (k=−1Xslope).

Ex Vivo Stability Assay

Peptidomimetic macrocycles with optimized linkers possess, for example, an ex vivo half-life that is at least two-fold greater than that of a corresponding uncrosslinked polypeptide, and possess an ex vivo half-life of 12 hours or more. For ex vivo serum stability studies, a variety of assays can be used. For example, a peptidomimetic macrocycle and a corresponding uncrosslinked polypeptide (2 mcg) are incubated with fresh mouse, rat and/or human serum (2 mL) at 37° C. for 0, 1, 2, 4, 8, and 24 hours. To determine the level of intact compound, the following procedure can be used: The samples are extracted by transferring 100 µl of sera to 2 ml centrifuge tubes followed by the addition of 10 µL of 50% formic acid and 500 µL acetonitrile and centrifugation at 14,000 RPM for 10 min at 4±2° C. The supernatants are then transferred to fresh 2 ml tubes and evaporated on Turbovap under $N_2$<10 psi, 37° C. The samples are reconstituted in 100 μL of 50:50 acetonitrile:water and submitted to LC-MS/MS analysis.

In vitro Binding Assays

To assess the binding and affinity of peptidomimetic macrocycles and peptidomimetic precursors to acceptor proteins, a fluorescence polarization assay (FPA) is used, for example. The FPA technique measures the molecular orientation and mobility using polarized light and fluorescent tracer. When excited with polarized light, fluorescent tracers (e.g., FITC) attached to molecules with high apparent molecular weights (e.g. FITC-labeled peptides bound to a large protein) emit higher levels of polarized fluorescence due to their slower rates of rotation as compared to fluorescent tracers attached to smaller molecules (e.g. FITC-labeled peptides that are free in solution).

For example, fluoresceinated peptidomimetic macrocycles (25 nM) are incubated with the acceptor protein (25-1000 nM) in binding buffer (140 mM NaCl, 50 mM Tris-HCL, pH 7.4) for 30 minutes at room temperature. Binding activity is measured, for example, by fluorescence polarization on a luminescence spectrophotometer (e.g. Perkin-Elmer LS50B). Kd values can be determined by non-linear regression analysis using, for example, Graphpad Prism software (GraphPad Software, Inc., San Diego, Calif.). A peptidomimetic macrocycle shows, In some embodiments, similar or lower Kd than a corresponding uncrosslinked polypeptide.

In Vitro Displacement Assays to Characterize Antagonists of Peptide-Protein Interactions To assess the binding and affinity of compounds that antagonize the interaction between a peptide and an acceptor protein, a fluorescence polarization assay (FPA) utilizing a fluoresceinated peptidomimetic macrocycle derived from a peptidomimetic precursor sequence is used, for example. The FPA technique measures the molecular orientation and mobility using polarized light and fluorescent tracer. When excited with polarized light, fluorescent tracers (e.g., FITC) attached to molecules with high apparent molecular weights (e.g. FITC-labeled peptides bound to a large protein) emit higher levels of polarized fluorescence due to their slower rates of rotation as compared to fluorescent tracers attached to smaller molecules (e.g. FITC-labeled peptides that are free in solution). A compound that antagonizes the interaction between the fluoresceinated peptidomimetic macrocycle and an acceptor protein will be detected in a competitive binding FPA experiment.

For example, putative antagonist compounds (1 nM to 1 mM) and a fluoresceinated peptidomimetic macrocycle (25 nM) are incubated with the acceptor protein (50 nM) in binding buffer (140 mM NaCl, 50 mM Tris-HCL, pH 7.4) for 30 minutes at room temperature. Antagonist binding activity is measured, for example, by fluorescence polarization on a luminescence spectrophotometer (e.g. Perkin-Elmer LS50B). Kd values can be determined by nonlinear regression analysis using, for example, Graphpad Prism software (GraphPad Software, Inc., San Diego, Calif.).

Any class of molecule, such as small organic molecules, peptides, oligonucleotides or proteins can be examined as putative antagonists in this assay.

Assay for Protein-Ligand Binding by Affinity Selection-Mass Spectrometry

To assess the binding and affinity of test compounds for proteins, an affinity-selection mass spectrometry assay is used, for example. Protein-ligand binding experiments are conducted according to the following representative procedure outlined for a system-wide control experiment using 1 μM peptidomimetic macrocycle plus 5 μM hMDM2. A 1 μL DMSO aliquot of a 40 μM stock solution of peptidomimetic macrocycle is dissolved in 19 μL of PBS (Phosphate-buffered saline: 50 mM, pH 7.5 Phosphate buffer containing 150 mM NaCl). The resulting solution is mixed by repeated pipetting and clarified by centrifugation at 10 000 g for 10 min. To a 4 μL aliquot of the resulting supernatant is added 4 μL of 10 μM hMDM2 in PBS. Each 8.0 μL experimental sample thus contains 40 pmol (1.5 μg) of protein at 5.0 μM concentration in PBS plus 1 μM peptidomimetic macrocycle and 2.5% DMSO. Duplicate samples thus prepared for each concentration point are incubated for 60 min at room temperature, and then chilled to 4° C. prior to size-exclusion chromatography-LC-MS analysis of 5.0 μL injections. Samples containing a target protein, protein-ligand complexes, and unbound compounds are injected onto an SEC column, where the complexes are separated from non-binding component by a rapid SEC step. The SEC column eluate is monitored using UV detectors to confirm that the early-eluting protein fraction, which elutes in the void volume of the SEC column, is well resolved from unbound components that are retained on the column. After the peak containing the protein and protein-ligand complexes elutes from the primary UV detector, it enters a sample loop where it is excised from the flow stream of the SEC stage and transferred directly to the LC-MS via a valving mechanism. The $(M+3H)^{3+}$ ion of the peptidomimetic macrocycle is observed by ESI-MS at the expected m/z, confirming the detection of the protein-ligand complex.

Assay for Protein-Ligand Kd Titration Experiments

To assess the binding and affinity of test compounds for proteins, a protein-ligand Kd titration experiment is performed, for example. Protein-ligand $K_d$ titrations experiments are conducted as follows: 2 μL DMSO aliquots of a serially diluted stock solution of titrant peptidomimetic macrocycle (5, 2.5, . . . , 0.098 mM) are prepared then dissolved in 38 μL of PBS. The resulting solutions are mixed by repeated pipetting and clarified by centrifugation at 10 000 g for 10 min. To 4.0 μL aliquots of the resulting supernatants is added 4.0 μL of 10 μM hMDM2 in PBS. Each 8.0 μL experimental sample thus contains 40 pmol (1.5 μg) of protein at 5.0 μM concentration in PBS, varying concentrations (125, 62.5, . . . , 0.24 μM) of the titrant peptide, and 2.5% DMSO. Duplicate samples thus prepared for each concentration point are incubated at room temperature for 30 min, then chilled to 4° C. prior to SEC-LC-MS analysis of 2.0 μL injections. The $(M+H)^{1+}$, $(M+2H)^{2+}$, $(M+3H)^{3+}$, and/or $(M+Na)^{1+}$ ion is observed by ESI-MS; extracted ion chromatograms are quantified, then fit to equations to derive the binding affinity $K_d$ as described in "*A General Technique to Rank Protein-Ligand Binding Affinities and Determine Allosteric vs. Direct Binding Site Competition in Compound Mixtures.*" Annis, D. A.; Nazef, N.; Chuang, C. C.; Scott, M. P.; Nash, H. M. *J. Am. Chem. Soc.* 2004, 126, 15495-15503; also in "*ALIS: An Affinity Selection-Mass Spectrometry System for the Discovery and Characterization of Protein-Ligand Interactions*" D. A. Annis, C.-C. Chuang, and N. Nazef. In Mass Spectrometry in Medicinal Chemistry. Edited by Wanner K, Höfner G: Wiley-VCH; 2007:121-184. Mannhold R, Kubinyi H, Folkers G (Series Editors): Methods and Principles in Medicinal Chemistry.

Assay for Competitive Binding Experiments by Affinity Selection-Mass Spectrometry To determine the ability of test compounds to bind competitively to proteins, an affinity selection mass spectrometry assay is performed, for example. A mixture of ligands at 40

M per component is prepared by combining 2 µL aliquots of 400 µM stocks of each of the three compounds with 14 µL of DMSO. Then, 1 µL aliquots of this 40 µM per component mixture are combined with 1 µL DMSO aliquots of a serially diluted stock solution of titrant peptidomimetic macrocycle (10, 5, 2.5, . . . , 0.078 mM). These 2 µL samples are dissolved in 38 µL of PBS. The resulting solutions were mixed by repeated pipetting and clarified by centrifugation at 10,000 g for 10 min. To 4.0 µL aliquots of the resulting supernatants is added 4.0 µL of 10 µM hMDM2 protein in PBS. Each 8.0 µL experimental sample thus contains 40 pmol (1.5 µg) of protein at 5.0 µM concentration in PBS plus 0.5 µM ligand, 2.5% DMSO, and varying concentrations (125, 62.5, . . . , 0.98 µM) of the titrant peptidomimetic macrocycle. Duplicate samples thus prepared for each concentration point are incubated at room temperature for 60 min, then chilled to 4° C. prior to SEC-LC-MS analysis of 2.0 µL injections. Additional details on these and other methods are provided in "*A General Technique to Rank Protein-Ligand Binding Affinities and Determine Allosteric vs. Direct Binding Site Competition in Compound Mixtures.*" Annis, D. A.; Nazef, N.; Chuang, C. C.; Scott, M. P.; Nash, H. M. *J. Am. Chem. Soc.* 2004, 126, 15495-15503; also in "*ALIS: An Affinity Selection-Mass Spectrometry System for the Discovery and Characterization of Protein-Ligand Interactions*" D. A. Annis, C.-C. Chuang, and N. Nazef. In Mass Spectrometry in Medicinal Chemistry. Edited by Wanner K, Höfner G: Wiley-VCH; 2007:121-184. Mannhold R, Kubinyi H, Folkers G (Series Editors): Methods and Principles in Medicinal Chemistry.

Binding Assays in Intact Cells

It is possible to measure binding of peptides or peptidomimetic macrocycles to their natural acceptors in intact cells by immunoprecipitation experiments. For example, intact cells are incubated with fluoresceinated (FITC-labeled) compounds for 4 hrs in the absence of serum, followed by serum replacement and further incubation that ranges from 4-18 hrs. Cells are then pelleted and incubated in lysis buffer (50 mM Tris [pH 7.6], 150 mM NaCl, 1% CHAPS and protease inhibitor cocktail) for 10 minutes at 4° C. Extracts are centrifuged at 14,000 rpm for 15 minutes and supernatants collected and incubated with 10 µl goat anti-FITC antibody for 2 hrs, rotating at 4° C. followed by further 2 hrs incubation at 4° C. with protein A/G Sepharose (50 µl of 50% bead slurry). After quick centrifugation, the pellets are washed in lysis buffer containing increasing salt concentration (e.g., 150, 300, 500 mM). The beads are then re-equilibrated at 150 mM NaCl before addition of SDS-containing sample buffer and boiling. After centrifugation, the supernatants are optionally electrophoresed using 4%-12% gradient Bis-Tris gels followed by transfer into Immobilon-P membranes. After blocking, blots are optionally incubated with an antibody that detects FITC and also with one or more antibodies that detect proteins that bind to the peptidomimetic macrocycle.

Cellular Penetrability Assays

A peptidomimetic macrocycle is, for example, more cell penetrable compared to a corresponding uncrosslinked macrocycle. Peptidomimetic macrocycles with optimized linkers possess, for example, cell penetrability that is at least two-fold greater than a corresponding uncrosslinked macrocycle, and often 20% or more of the applied peptidomimetic macrocycle will be observed to have penetrated the cell after 4 hours. To measure the cell penetrability of peptidomimetic macrocycles and corresponding uncrosslinked macrocycle, intact cells are incubated with fluorescently-labeled (e.g. fluoresceinated) peptidomimetic macrocycles or corresponding uncrosslinked macrocycle (10 µM) for 4 hrs in serum free media at 37° C., washed twice with media and incubated with trypsin (0.25%) for 10 min at 37° C. The cells are washed again and resuspended in PBS. Cellular fluorescence is analyzed, for example, by using either a FACSCalibur flow cytometer or Cellomics' KineticScan® HCS Reader.

Cellular Efficacy Assays

The efficacy of certain peptidomimetic macrocycles is determined, for example, in cell-based killing assays using a variety of tumorigenic and non-tumorigenic cell lines and primary cells derived from human or mouse cell populations. Cell viability is monitored, for example, over 24-96 hrs of incubation with peptidomimetic macrocycles (0.5 to 50 µM) to identify those that kill at $EC_{50}<10$ µM. Several standard assays that measure cell viability are commercially available and are optionally used to assess the efficacy of the peptidomimetic macrocycles. In addition, assays that measure Annexin V and caspase activation are optionally used to assess whether the peptidomimetic macrocycles kill cells by activating the apoptotic machinery. For example, the Cell Titer-glo assay is used which determines cell viability as a function of intracellular ATP concentration.

In Vivo Stability Assay

To investigate the in vivo stability of the peptidomimetic macrocycles, the compounds are, for example, administered to mice and/or rats by IV, IP, PO or inhalation routes at concentrations ranging from 0.1 to 50 mg/kg and blood specimens withdrawn at 0', 5', 15', 30', 1 hr, 4 hrs, 8 hrs and 24 hours post-injection. Levels of intact compound in 25 µL of fresh serum are then measured by LC-MS/MS as above.

In vivo Efficacy in Animal Models

To determine the anti-oncogenic activity of peptidomimetic macrocycles in vivo, the compounds are, for example, given alone (IP, IV, PO, by inhalation or nasal routes) or in combination with sub-optimal doses of relevant chemotherapy (e.g., cyclophosphamide, doxorubicin, etoposide). In one example, $5 \times 10^6$ RS4; 11 cells (established from the bone marrow of a patient with acute lymphoblastic leukemia) that stably express luciferase are injected by tail vein in NOD-SCID mice 3 hrs after they have been subjected to total body irradiation. If left untreated, this form of leukemia is fatal in 3 weeks in this model. The leukemia is readily monitored, for example, by injecting the mice with D-luciferin (60 mg/kg) and imaging the anesthetized animals (e.g., Xenogen In Vivo Imaging System, Caliper Life Sciences, Hopkinton, Mass.). Total body bioluminescence is quantified by integration of photonic flux (photons/sec) by Living Image Software (Caliper Life Sciences, Hopkinton, Mass.). Peptidomimetic macrocycles alone or in combination with sub-optimal doses of relevant chemotherapeutics agents are, for example, administered to leukemic mice (10 days after injection/day 1 of experiment, in bioluminescence range of 14-16) by tail vein or IP routes at doses ranging from 0.1 mg/kg to 50 mg/kg for 7 to 21 days. Optionally, the mice are imaged throughout the experiment every other day and survival monitored daily for the duration of the experiment. Expired mice are optionally subjected to necropsy at the end of the experiment. Another animal model is implantation into NOD-SCID mice of DoHH2, a cell line derived from human follicular lymphoma, that stably expresses luciferase. These in vivo tests optionally generate preliminary pharmacokinetic, pharmacodynamic and toxicology data.

Clinical Trials

To determine the suitability of the peptidomimetic macrocycles for treatment of humans, clinical trials are performed. For example, patients diagnosed with liquid cancer and in need of treatment can be selected and separated in treatment and one or more control groups, wherein the treatment group is administered a peptidomimetic macrocycle, while the control groups receive a placebo or a known anti-cancer drug. The treatment safety and efficacy of the peptidomimetic macrocycles can thus be evaluated by performing comparisons of the patient groups with respect to factors such as survival and quality-of-life. In this example, the patient group treated with a peptidomimetic macrocycle can show improved long-term survival compared to a patient control group treated with a placebo.

Formulation and Administration

Mode of Administration

An effective amount of a peptidomimetic macrocycles of the disclosure can be administered in either single or multiple doses by any of the accepted modes of administration. In some embodiments, the peptidomimetic macrocycles of the disclosure are administered parenterally, for example, by subcutaneous, intramuscular, intrathecal, intravenous or epidural injection. For example, the peptidomimetic macrocycle is administered intravenously, intraarterially, subcutaneously or by infusion. In some examples, the peptidomimetic macrocycle is administered intravenously. In some examples, the peptidomimetic macrocycle is administered intraarterially.

Regardless of the route of administration selected, the peptidomimetic macrocycles of the present disclosure, and/or the pharmaceutical compositions of the present disclosure, are formulated into pharmaceutically-acceptable dosage forms. The peptidomimetic macrocycles according to the disclosure can be formulated for administration in any convenient way for use in human or veterinary medicine, by analogy with other pharmaceuticals.

In one aspect, the disclosure provides pharmaceutical formulation comprising a therapeutically-effective amount of one or more of the peptidomimetic macrocycles described above, formulated together with one or more pharmaceutically acceptable carriers (additives) and/or diluents. In one embodiment, one or more of the peptidomimetic macrocycles described herein are formulated for parenteral administration for parenteral administration, one or more peptidomimetic macrocycles disclosed herein can be formulated as aqueous or nonaqueous solutions, dispersions, suspensions or emulsions or sterile powders which can be reconstituted into sterile injectable solutions or dispersions just prior to use. Such formulations can comprise sugars, alcohols, antioxidants, buffers, bacteriostats, solutes which render the formulation isotonic with the blood of the intended recipient or suspending or thickening agents. These compositions can also contain adjuvants such as preservatives, wetting agents, emulsifying agents and dispersing agents. Prevention of the action of microorganisms upon the subject compounds can be ensured by the inclusion of various antibacterial and antifungal agents, for example, paraben, chlorobutanol, phenol sorbic acid, and the like. It can also be desirable to include isotonic agents, such as sugars, sodium chloride, and the like into the compositions. In addition, prolonged absorption of the injectable pharmaceutical form can be brought about by the inclusion of agents which delay absorption such as aluminum monostearate and gelatin. If desired the formulation can be diluted prior to use with, for example, an isotonic saline solution or a dextrose solution. In some examples, the peptidomimetic macrocycle is formulated as an aqueous solution and is administered intravenously.

Amount and Frequency of Administration

Dosing can be determined using various techniques. The selected dosage level can depend upon a variety of factors including the activity of the particular peptidomimetic macrocycle employed, the route of administration, the time of administration, the rate of excretion or metabolism of the particular peptidomimetic macrocycle being employed, the duration of the treatment, other drugs, compounds and/or materials used in combination with the particular peptidomimetic macrocycle employed, the age, sex, weight, condition, general health and prior medical history of the patient being treated, and like factors well known in the medical arts. The dosage values can also vary with the severity of the condition to be alleviated. For any particular subject, specific dosage regimens can be adjusted over time according to the individual need and the professional judgment of the person administering or supervising the administration of the compositions.

A physician or veterinarian can prescribe the effective amount of the compound required. For example, the physician or veterinarian could start doses of the compounds of the disclosure employed in the compound at levels lower than that required in order to achieve the desired therapeutic effect and gradually increase the dosage until the desired effect is achieved.

In some embodiments, a suitable daily dose of a peptidomimetic macrocycle of the disclosure can be that amount of the peptidomimetic macrocycle which is the lowest dose effective to produce a therapeutic effect. Such an effective dose will generally depend upon the factors described above. The precise time of administration and amount of any particular peptidomimetic macrocycle that will yield the most effective treatment in a given patient will depend upon the activity, pharmacokinetics, and bioavailability of a particular peptidomimetic macrocycle, physiological condition of the patient (including age, sex, disease type and stage, general physical condition, responsiveness to a given dosage and type of medication), route of administration, and the like.

Dosage can be based on the amount of the peptidomimetic macrocycle per kg body weight of the patient. Alternatively, the dosage of the subject disclosure can be determined by reference to the plasma concentrations of the peptidomimetic macrocycle. For example, the maximum plasma concentration (Cmax) and the area under the plasma concentration-time curve from time 0 to infinity (AUC) can be used.

In some embodiments, the subject is a human subject and the amount of the compound administered is 0.01-100 mg per kilogram body weight of the human subject. For example, in various examples, the amount of the compound administered is about 0.01-50 mg/kg, about 0.01-20 mg/kg, about 0.01-10 mg/kg, about 0.1-100 mg/kg, about 0.1-50 mg/kg, about 0.1-20 mg/kg, about 0.1-10 mg/kg, about 0.5-100 mg/kg, about 0.5-50 mg/kg, about 0.5-20 mg/kg, about 0.5-10 mg/kg, about 1-100 mg/kg, about 1-50 mg/kg, about 1-20 mg/kg, about 1-10 mg/kg body weight of the human subject. In one embodiment, about 0.5 mg-10 mg of the peptidomimetic macrocycle per kilogram body weight of the human subject is administered. In some examples the amount of the compound administered is about 0.16 mg, about 0.32 mg, about 0.64 mg, about 1.28 mg, about 3.56 mg, about 7.12 mg, about 14.24 mg, or about 20 mg per kilogram body weight of the human subject. In some examples the amount of the compound administered is about 0.16 mg, about 0.32 mg, about 0.64 mg, about 1.28 mg, about 3.56 mg, about 7.12 mg, or about 14.24 mg per kilogram body weight of the human subject. In some examples the amount of the compound administered is about 0.16 mg per kilogram body weight of the human subject. In some examples the amount of the compound administered is about 0.32 mg per kilogram body weight of the human subject. In some examples the amount of the compound administered is about 0.64 mg per kilogram body weight of the human subject. In some examples the amount of the compound administered is about 1.28 mg per kilogram body weight of the human subject. In some examples the amount of the compound administered is about 3.56 mg per kilogram body weight of the human subject. In some examples the amount of the compound administered is about 7.12 mg per kilogram body weight of the human subject. In some examples the amount of the compound administered is about 14.24 mg per kilogram body weight of the human subject.

In some embodiments about 0.5-about 20 mg or about 0.5-about 10 mg of the compound per kilogram body weight of the human subject is administered two times a week. For example about 0.5-about 1 mg, about 0.5-about 5 mg, about 0.5-about 10 mg, about 0.5-about 15 mg, about 1-about 5 mg, about 1-about 10 mg, about 1-about 15 mg, about 1-about 20 mg, about 5-about 10 mg, about 1-about 15 mg, about 5-about 20 mg, about 10-about 15 mg, about 10-about 20 mg, or about 15-about 20 mg of the compound per kilogram body weight of the human subject is administered about twice a week. In some examples about 1 mg, about 1.25 mg, about 1.5 mg, about 1.75 mg, about 2 mg, about 2.25 mg, about 2.5 mg, about 2.75 mg, about 3 mg, about 3.25 mg, about 3.5 mg, about 3.75 mg, about 4 mg, about 4.25 mg, about 4.5 mg, about 4.75 mg, about 5 mg, about 5.25 mg, about 5.5 mg, about 5.75 mg, about 6 mg, about 6.25 mg, about 6.5 mg, about 6.75 mg, about 7 mg, about 7.25 mg, about 7.5 mg, about 7.75 mg, about 8 mg, about 8.25 mg, about 8.5 mg, about 8.75 mg, about 9 mg, about 9.25 mg, about 9.5 mg, about 9.75 mg, about 10 mg, about 10.25 mg, about 10.5 mg, about 10.75 mg, about 11 mg, about 11.25 mg, about 11.5 mg, about 11.75 mg, about 12 mg, about 12.25 mg, about 12.5 mg, about 12.75 mg, about 13 mg, about 13.25 mg, about 13.5 mg, about 13.75 mg, about 14 mg, about 14.25 mg, about 14.5 mg, about 14.75 mg, about 15 mg, about 15.25 mg, about 15.5 mg, about 15.75 mg, about 16 mg, about 16.5 mg, about 17 mg, about 17.5 mg, about 18 mg, about 18.5 mg, about 19 mg, about 19.5 mg, or about 20 mg of the compound per kilogram body weight of the human subject is administered two times a week. In some examples, the amount of the compound administered is about 1.25 mg, about 2.5 mg, about 5 mg, about 10 mg, or about 20 mg per kilogram body weight of the human subject and the compound is administered two times a week. In some examples, the amount of the compound administered is about 1.25 mg, about 2.5 mg, about 5 mg or about 10 mg per kilogram body weight of the human subject and the compound is administered two times a week.

In some embodiments about 0.5-about 20 mg or about 0.5-about 10 mg of the compound per kilogram body weight of the human subject is administered once a week. For example about 0.5-about 1 mg, about 0.5-about 5 mg, about 0.5-about 10 mg, about 0.5-about 15 mg, about 1-about 5 mg, about 1-about 10 mg, about 1-about 15 mg, about 1-about 20 mg, about 5-about 10 mg, about 1-about 15 mg, about 5-about 20 mg, about 10-about 15 mg, about 10-about 20 mg, or about 15-about 20 mg of the compound per kilogram body weight of the human subject is administered once a week. In some examples about 1 mg, about 1.25 mg, about 1.5 mg, about 1.75 mg, about 2 mg, about 2.25 mg, about 2.5 mg, about 2.75 mg, about 3 mg, about 3.25 mg, about 3.5 mg, about 3.75 mg, about 4 mg, about 4.25 mg, about 4.5 mg, about 4.75 mg, about 5 mg, about 5.25 mg, about 5.5 mg, about 5.75 mg, about 6 mg, about 6.25 mg, about 6.5 mg, about 6.75 mg, about 7 mg, about 7.25 mg, about 7.5 mg, about 7.75 mg, about 8 mg, about 8.25 mg, about 8.5 mg, about 8.75 mg, about 9 mg, about 9.25 mg, about 9.5 mg, about 9.75 mg, about 10 mg, about 10.25 mg, about 10.5 mg, about 10.75 mg, about 11 mg, about 11.25 mg, about 11.5 mg, about 11.75 mg, about 12 mg, about 12.25 mg, about 12.5 mg, about 12.75 mg, about 13 mg, about 13.25 mg, about 13.5 mg, about 13.75 mg, about 14 mg, about 14.25 mg, about 14.5 mg, about 14.75 mg, about 15 mg, about 15.25 mg, about 15.5 mg, about 15.75 mg, about 16 mg, about 16.5 mg, about 17 mg, about 17.5 mg, about 18 mg, about 18.5 mg, about 19 mg, about 19.5 mg, or about 20 mg of the compound per kilogram body weight of the human subject is administered once a week. In some examples, the amount of the compound administered is about 1.25 mg, about 2.5 mg, about 5 mg, about 10 mg, or about 20 mg per kilogram body weight of the human subject and the compound is administered once a week. In some examples, the amount of the compound administered is about 1.25 mg, about 2.5 mg, about 5 mg or about 10 mg per kilogram body weight of the human subject and the compound is administered once a week In some embodiments about 0.5-about 20 mg or about 0.5-about 10 mg of the compound per kilogram body weight of the human subject is administered 3, 4, 5, 6, or 7 times a week. For example, about 0.5-about 1 mg, about 0.5-about 5 mg, about 0.5-about 10 mg, about 0.5-about 15 mg, about 1-about 5 mg, about 1-about 10 mg, about 1-about 15 mg, about 1-about 20 mg, about 5-about 10 mg, about 1-about 15 mg, about 5-about 20 mg, about 10-about 15 mg, about 10-about 20 mg, or about 15-about 20 mg of the compound per kilogram body weight of the human subject is administered 3, 4, 5, 6, or 7 times a week. In some examples about 1 mg, about 1.25 mg, about 1.5 mg, about 1.75 mg, about 2 mg, about 2.25 mg, about 2.5 mg, about 2.75 mg, about 3 mg, about 3.25 mg, about 3.5 mg, about 3.75 mg, about 4 mg, about 4.25 mg, about 4.5 mg, about 4.75 mg, about 5 mg, about 5.25 mg, about 5.5 mg, about 5.75 mg, about 6 mg, about 6.25 mg, about 6.5 mg, about 6.75 mg, about 7 mg, about 7.25 mg, about 7.5 mg, about 7.75 mg, about 8 mg, about 8.25 mg, about 8.5 mg, about 8.75 mg, about 9 mg, about 9.25 mg, about 9.5 mg, about 9.75 mg, about 10 mg, about 10.25 mg, about 10.5 mg, about 10.75 mg, about 11 mg, about 11.25 mg, about 11.5 mg, about 11.75 mg, about 12 mg, about 12.25 mg, about 12.5 mg, about 12.75 mg, about 13 mg, about 13.25 mg, about 13.5 mg, about 13.75 mg, about 14 mg, about 14.25 mg, about 14.5 mg, about 14.75 mg, about 15 mg, about 15.25 mg, about 15.5 mg, about 15.75 mg, about 16 mg, about 16.5 mg, about 17 mg, about 17.5 mg, about 18 mg, about 18.5 mg, about 19 mg, about 19.5 mg, or about 20 mg of the compound per kilogram body weight of the human subject is administered 3, 4, 5, 6, or 7 times a week. In some examples, the amount of the compound administered is about 1.25 mg, about 2.5 mg, about 5 mg, about 10 mg, or about 20 mg per kilogram body weight of the human subject and the compound is administered 3, 4, 5, 6, or 7 times a week. In some examples, the amount of the compound administered is about 1.25 mg, about 2.5 mg, about 5 mg, or about 10 mg per kilogram body weight of the human subject and the compound is administered 3, 4, 5, 6, or 7 times a week.

In some embodiments, about 0.5-about 20 mg or about 0.5-about 10 mg of the compound per kilogram body weight of the human subject is administered once every 2, 3, or 4 weeks. For example, about 0.5-about 1 mg, about 0.5-about 5 mg, about 0.5-about 10 mg, about 0.5-about 15 mg, about 1-about 5 mg, about 1-about 10 mg, about 1-about 15 mg, about 1-about 20 mg, about 5-about 10 mg, about 1-about 15 mg, about 5-about 20 mg, about 10-about 15 mg, about 10-about 20 mg, or about 15-about 20 mg of the compound per kilogram body weight of the human subject is administrated 3, 4, 5, 6, or 7 once every 2 or 3 week. In some examples about 1 mg, about 1.25 mg, about 1.5 mg, about 1.75 mg, about 2 mg, about 2.25 mg, about 2.5 mg, about 2.75 mg, about 3 mg, about 3.25 mg, about 3.5 mg, about 3.75 mg, about 4 mg, about 4.25 mg, about 4.5 mg, about 4.75 mg, about 5 mg, about 5.25 mg, about 5.5 mg, about 5.75 mg, about 6 mg, about 6.25 mg, about 6.5 mg, about 6.75 mg, about 7 mg, about 7.25 mg, about 7.5 mg, about 7.75 mg, about 8 mg, about 8.25 mg, about 8.5 mg, about 8.75 mg, about 9 mg, about 9.25 mg, about 9.5 mg, about 9.75 mg, about 10 mg, about 10.25 mg, about 10.5 mg, about 10.75 mg, about 11 mg, about 11.25 mg, about 11.5 mg, about 11.75 mg, about 12 mg, about 12.25 mg, about 12.5 mg, about 12.75 mg, about 13 mg, about 13.25 mg, about 13.5 mg, about 13.75 mg, about 14 mg, about 14.25 mg, about 14.5 mg, about 14.75 mg, about 15 mg, about 15.25 mg, about 15.5 mg, about 15.75 mg, about 16 mg, about 16.5 mg, about 17 mg, about 17.5 mg, about 18 mg, about 18.5 mg, about 19 mg, about 19.5 mg, or about 20 mg of the compound per kilogram body weight of the human subject is administered once every 2 or 3 weeks. In some examples, the amount of the compound administered is about 1.25 mg, about 2.5 mg, about 5 mg, about 10 mg, or about 20 mg per kilogram body weight of the human subject and the compound is administered once every 2 weeks. In some examples, the amount of the compound administered is about 1.25 mg, about 2.5 mg, about 5 mg or about 10 mg per kilogram body weight of the human subject and the compound is administered once every 2 weeks. In some examples, the amount of the compound administered is about 1.25 mg, about 2.5 mg, about 5 mg, about 10 mg, or about 20 mg per kilogram body weight of the human subject and the compound is administered once every 3 weeks. In some examples, the amount of the compound administered is about 1.25 mg, about 2.5 mg, about 5 mg, or about 10 mg per kilogram body weight of the human subject and the compound is administered once every 3 weeks.

In some embodiments, the compound is administered gradually over a period of time. A desired amount of compound can, for example can be administered gradually over a period of from about 0.1 h-24 h. In some cases a desired amount of compound is administered gradually over a period of 0.1 h, 0.5 h, 1 h, 1.5 h, 2 h, 2.5 h, 3 h, 3.5 h, 4 h, 4.5 h, 5 h, 6 h, 7 h, 8 h, 9 h, 10 h, 11 h, 12 h, 13 h, 14 h, 15 h, 16 h, 17 h, 18 h, 19 h, 20 h, 21 h, 22 h, 23 h, or 24 h. In some examples, a desired amount of compound is administered gradually over a period of 0.25-12 h, for example over a period of 0.25-1 h, 0.25-2 h, 0.25-3 h, 0.25-4 h, 0.25-6 h, 0.25-8 h, 0.25-10 h. In some examples, a desired amount of compound is administered gradually over a period of 0.25-2 h. In some examples, a desired amount of compound is administered gradually over a period of 0.25-1 h. In some examples, a desired amount of compound is administered gradually over a period of 0.25 h, 0.3 h, 0.4 h, 0.5 h, 0.6 h, 0.7 h, 0.8 h, 0.9 h, 1.0 h, 1.1 h, 1.2 h, 1.3 h, 1.4 h, 1.5 h, 1.6 h, 1.7 h, 1.8 h, 1.9 h, or 2.0 h. In some examples, a desired amount of compound is administered gradually over a period of 1 h. In some examples, a desired amount of compound is administered gradually over a period of 2 h.

Administration of the compound can continue as long as necessary. In some embodiments, one or more compound of the disclosure is administered for more than 1 day, more than 1 week, more than 1 month, more than 2 months, more than 3 months, more than 4 months, more than 5 months, more than 6 months, more than 7 months, more than 8 months, more than 9 months, more than 10 months, more than 11 months, more than 12 months, more than 13 months, more than 14 months, more than 15 months, more than 16 months, more than 17 months, more than 18 months, more than 19 months, more than 20 months, more than 21 months, more than 22 months, more than 23 months, or more than 24 months. In some embodiments, one or more compound of the disclosure is administered for less than 1 week, less than 1 month, less than 2 months, less than 3 months, less than 4 months, less than 5 months, less than 6 months, less than 7 months, less than 8 months, less than 9 months, less than 10 months, less than 11 months, less than 12 months, less than 13 months, less than 14 months, less than 15 months, less than 16 months, less than 17 months, less than 18 months, less than 19 months, less than 20 months, less than 21 months, less than 22 months, less than 23 months, or less than 24 months.

In some embodiments, the compound is administered on day 1, 8, 15 and 28 of a 28 day cycle. In some embodiments, the compound is administered on day 1, 8, 15 and 28 of a 28 day cycle and administration is continued for two cycles. In some embodiments, the compound is administered on day 1, 8, 15 and 28 of a 28 day cycle and administration is continued for three cycles. In some embodiments, the compound is administered on day 1, 8, 15 and 28 of a 28 day cycle and administration is continued for 4, 5, 6, 7, 8, 9, 10, or more cycles.

In some embodiments, the compound is administered on day 1, 8, 11 and 21 of a 21 day cycle. In some embodiments, the compound is administered on day 1, 8, 11 and 21 of a 21 day cycle and administration is continued for two cycles. In some embodiments, the compound is administered on day 1, 8, 11 and 21 of a 21 day cycle and administration is continued for three cycles. In some embodiments, the compound is administered on day 1, 8, 11 and 21 of a 21 day cycle and administration is continued for 4, 5, 6, 7, 8, 9, 10, or more cycles.

In some embodiments, one or more compound of the disclosure is administered chronically on an ongoing basis. In some embodiments administration of one or more compound of the disclosure is continued until documentation of disease progression, unacceptable toxicity, or patient or physician decision to discontinue administration.

Method and Uses

In one aspect, the disclosure provides a method of treating liquid cancer in a subject, the method comprising administering to the subject a therapeutically effective amount of a peptidomimetic macrocycle or a pharmaceutically acceptable salt thereof, wherein the peptidomimetic macrocycle binds to MDM2 and/or MDMX proteins. In some embodiments, the peptidomimetic macrocycle can disrupt the interaction between p53 and MDM2 and MDMX. In some embodiments, treatment according to the method disclosed herein can result in re-activation of the p53 pathway, decreased liquid cancer cell proliferation, increased p53 protein, increased p21, and/or increased apoptosis in the human subject.

In one aspect, the disclosure provides a method of treating liquid cancer, determined to lack a p53 deactivating mutation, in a subject the method comprising administering to the subject a therapeutically effective amount of a peptidomimetic macrocycle or a pharmaceutically acceptable salt thereof, wherein the peptidomimetic macrocycle binds to MDM2 and/or MDMX proteins. In some embodiments, the peptidomimetic macrocycle can disrupt the interaction between p53 and MDM2 and MDMX. The method further can comprise confirming the lack of the p53 deactivating mutation in the subject prior to the administration of the peptidomimetic macrocycle. In some embodiments, treatment according to the method disclosed herein can result in re-activation of the p53 pathway, decreased liquid cancer cell proliferation, increased p53 protein, increased p21, and/or increased apoptosis in the human subject.

In one aspect, the disclosure provides a method of treating liquid cancer in a subject expressing wild type p53, the method comprising administering to the subject a therapeutically effective amount of a peptidomimetic macrocycle or a pharmaceutically acceptable salt thereof, wherein the peptidomimetic macrocycle binds to MDM2 and/or MDMX proteins. In some embodiments, the peptidomimetic macrocycle can disrupt the interaction between p53 and MDM2 and MDMX. The method further can comprise confirming the wild type p53 status of the subject prior to the administration of the peptidomimetic macrocycle. In some embodiments, treatment according to the method disclosed herein can result in re-activation of the p53 pathway, decreased liquid cancer cell proliferation, increased p53 protein, increased p21, and/or increased apoptosis in the human subject.

In some embodiments, the methods for treating liquid cancer provided herein inhibit, reduce, diminish, arrest, or stabilize a liquid cancer cell, such as a CTC or an MNBC, associated with the liquid cancer. In other embodiments, the methods for treating liquid cancer provided herein inhibit, reduce, diminish, arrest, or stabilize the symptoms associated with the liquid cancer or two or more symptoms thereof. In some examples, the methods for treating liquid cancer provided herein cause the reduction in the number of liquid cancer cells and/or one or more symptoms associated with the liquid cancer. In other examples, the methods for treating liquid cancer provided herein maintain the number of liquid cancer cells so that they do not increase, or so that the number of liquid cancer cells increases by less than the increase of a number of liquid cancer cells after administration of a standard therapy as measured by, for example, conventional methods available to one of skill in the art, such as ultrasound, CT Scan, MRI, dynamic contrast-enhanced MRI, or PET Scan. In some examples, the methods for treating liquid cancer provided herein decrease the number of liquid cancer cells. In some examples, the methods for treating liquid cancer provided herein reduce the formation of liquid cancer cells. In some examples, the methods for treating liquid cancer provided herein eradicate, remove, or control primary, regional and/or metastatic liquid cancer cells associated with the liquid cancer. In some examples, the methods for treating liquid cancer provided herein decrease the number or size of metastases associated with the liquid cancer. In some examples, the methods for treating liquid cancer provided herein reduce the number of liquid cancer cells in a subject by an amount in the range of about 5-about 10%, about 5-about 20%, about 10-about 20%, about 15-about 20%, about 10-about 30%, about 20-about 30%, about 20-about 40%, about 30-about 40%, about 10-about 50%, about 20-about 50%, about 30-about 50%, about 40-about 50%, about 10-about 60%, about 20-about 60%, about 30-about 60%, about 40-about 60%, about 50-about 60%, about 10-about 70%, about 20-about 70%, about 30-about 70%, about 40-about 70%, about 50-about 70%, about 60-about 70%, about 10-about 80%, about 20-about 80%, about 30-about 80%, about 40-about 80%, about 50-about 80%, about 60-about 80%, about 70-about 80%, about 10-about 90%, about 20-about 90%, about 30-about 90%, about 40-about 90%, about 50-about 90%, about 60-about 90%, about 70-about 90%, about 80-about 90%, about 10-about 100%, about 20%-about 100%, about 30-about 100%, about 40-about 100%, about 50-about 100%, about 60-about 100%, about 70-about 100%, about 80-about 100%, about 90-about 100%, about 95-about 100%, or any range in between, relative to the number of liquid cancer cells in a subject prior to administration of the peptidomimetic macrocycles as assessed by, for example, CT Scan, MRI, DCE-MRI, or PET Scan. In certain embodiments, the methods herein reduce the number of liquid cancer cells in a subject by at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 99%, or about 100%, relative to the number of liquid cancer cells prior to administration of the peptidomimetic macrocycle as assessed by, for example, CT Scan, MRI, DCE-MRI, or PET Scan.

In some embodiments, the methods provided herein reduce the liquid cancer cell perfusion in a subject by an amount in the range of about 5-about 10%, about 5-about 20%, about 10-about 20%, about 15-about 20%, about 10-about 30%, about 20-about 30%, about 20-about 40%, about 30-about 40%, about 10-about 50%, about 20-about 50%, about 30-about 50%, about 40-about 50%, about 10-about 60%, about 20-about 60%, about 30-about 60%, about 40-about 60%, about 50-about 60%, about 10-about 70%, about 20-about 70%, about 30-about 70%, about 40-about 70%, about 50-about 70%, about 60-about 70%, about 10-about 80%, about 20-about 80%, about 30-about 80%, about 40-about 80%, about 50-about 80%, about 60-about 80%, about 70-about 80%, about 10-about 90%, about 20-about 90%, about 30-about 90%, about 40-about 90%, about 50-about 90%, about 60-about 90%, about 70-about 90%, about 80-about 90%, about 10-about 100%, about 20%-about 100%, about 30-about 100%, about 40-about 100%, about 50-about 100%, about 60-about 100%, about 70-about 100%, about 80-about 100%, about 90-about 100%, about 95-about 100%, or any range in between, relative to liquid cancer cell perfusion prior to administration of the peptidomimetic macrocycle, as assessed by, for example, MRI, DCE-MRI, or PET Scan. In certain embodiments, the methods provided herein reduce the liquid cancer cell perfusion in a subject by at least about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 99%, or about 100%, relative to liquid cancer cell perfusion prior to administration of the peptidomimetic macrocycle as assessed by, for example, MRI, DCE-MRI, or PET Scan.

In some embodiments, the methods provided herein inhibit or decrease liquid cancer cell metabolism in a subject in the range of about 5-about 10%, about 5-about 20%, about 10-about 20%, about 15-about 20%, about 10-about 30%, about 20-about 30%, about 20-about 40%, about 30-about 40%, about 10-about 50%, about 20-about 50%, about 30-about 50%, about 40-about 50%, about 10-about 60%, about 20-about 60%, about 30-about 60%, about 40-about 60%, about 50-about 60%, about 10-about 70%, about 20-about 70%, about 30-about 70%, about 40-about 70%, about 50-about 70%, about 60-about 70%, about 10-about 80%, about 20-about 80%, about 30-about 80%, about 40-about 80%, about 50-about 80%, about 60-about 80%, about 70-about 80%, about 10-about 90%, about 20-about 90%, about 30-about 90%, about 40-about 90%, about 50-about 90%, about 60-about 90%, about 70-about 90%, about 80-about 90%, about 10-about 100%, about 20%-about 100%, about 30-about 100%, about 40-about 100%, about 50-about 100%, about 60-about 100%, about 70-about 100%, about 80-about 100%, about 90-about 100%, about 95-about 100%, or any range in between, relative to liquid cancer cell metabolism prior to administration of the peptidomimetic macrocycle, as assessed by, for example, MRI, DCE-MRI, or PET Scan. In certain embodiments, the methods provided herein inhibit or decrease liquid cancer cell metabolism in a subject as assessed by, for example, PET scanning. In specific embodiments, the methods provided herein inhibit or decrease liquid cancer cell metabolism in a subject by at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or about 100%, relative to liquid cancer cell metabolism prior to administration of the peptidomimetic macrocycle.

In other aspect, the disclosure provides a method for increasing the survival time of a subject with liquid cancer determined to lack a p53 deactivating mutation and/or with liquid cancer expressing wild type p53, the method comprising administering to the subject a therapeutically effective amount of a peptidomimetic macrocycle or a pharmaceutically acceptable salt thereof, wherein the peptidomimetic macrocycle binds to MDM2 and/or MDMX proteins. In some examples, the survival time of the subject is at least 30 days longer than the expected survival time of the subject if the subject was not treated according to the methods provided herein. In some examples, the survival time of the subject is at 1 month-about 5 years longer than the expected survival time of the subject if the subject was not treated according to the methods provided herein. For example, the survival time of the subject is at least 3 months, at least 6 months, at least 9 months, at least 12 months, at least 15 months, at least 18 months, at least 21 months, or at least 24 months longer than the expected survival time of the subject if the subject was not treated according to the methods disclosed herein disclosure.

In one aspect, the disclosure provides a method to assessed presence, absence or amount of the biomarker in a subject suffering with liquid cancer. In some examples, the biomarkers include patient biomarkers, for example, the p53 status of the subject and the MDM2 and MDMX expression levels in the subject.

The method of the disclosure can also optionally include studying and/or evaluating the safety and/or tolerability of the peptidomimetic macrocycles disclosed herein in the subject.

Also provided herein is a method to re-activate the p53 pathway in a subject with a liquid cancer lacking a p53 deactivating mutation and/or expressing wild type p53, the method comprising administering to the subject a therapeutically effective amount of a peptidomimetic macrocycle or a pharmaceutically acceptable salt thereof, wherein the peptidomimetic macrocycle binds to MDM2 and/or MDMX proteins.

Also provided herein is a method to decrease liquid cancer cell proliferation in a human subject with a liquid cancer lacking a p53 deactivating mutation and/or expressing wild type p53, the method comprising administering to the subject a therapeutically effective amount of a peptidomimetic macrocycle or a pharmaceutically acceptable salt thereof, wherein the peptidomimetic macrocycle binds to MDM2 and/or MDMX proteins.

Also provided herein is a method to increased p53 protein in a subject with a liquid cancer lacking a p53 deactivating mutation and/or expressing wild type p53, the method comprising administering to the subject a therapeutically effective amount of a peptidomimetic macrocycle or a pharmaceutically acceptable salt thereof, wherein the peptidomimetic macrocycle binds to MDM2 and/or MDMX proteins.

Also provided herein is a method to increased p21 in a subject with a liquid cancer lacking a p53 deactivating mutation and/or expressing wild type p53, the method comprising administering to the subject a therapeutically effective amount of a peptidomimetic macrocycle or a pharmaceutically acceptable salt thereof, wherein the peptidomimetic macrocycle binds to MDM2 and/or MDMX proteins.

Also provided herein is a method to increased apoptosis in a subject with a liquid cancer lacking a p53 deactivating mutation and/or expressing wild type p53, the method comprising administering to the subject a therapeutically effective amount of a peptidomimetic macrocycle or a pharmaceutically acceptable salt thereof, wherein the peptidomimetic macrocycle binds to MDM2 and/or MDMX proteins.

In some embodiments, the disclosure also provides a method to determine the dose limiting toxicities (DLTs) and/or maximum tolerated dose (MTD or OBD) or the optimal biological dose (OBD) of the peptidomimetic macrocycles disclosed herein in subject with a liquid cancer (e.g., a liquid lymphoma) lacking a p53 deactivating mutation and/or expressing wild type p53.

The methods of the disclosure can optionally include pharmacokinetic analysis of the peptidomimetic macrocycles disclosed herein. Accordingly, the methods can further comprise collecting one or more biological sample from the subject at one or more specific time point and analyzing the one or more biological sample for levels of the peptidomimetic macrocycles and/or it metabolites. The biological sample can be a blood sample from the subject, for example, a blood sample from a human subject. The one or more specific time point can include time points before, after and/or during the administration of the peptidomimetic macrocycle to the subject. In some embodiments one or more biological sample includes biological samples collected before and after each administration of the peptidomimetic macrocycle to the subject. In some embodiments a biological sample for pharmacokinetic analysis is collected before the first administration of the peptidomimetic macrocycle to the subject and at one or more time points after each administration of the peptidomimetic macrocycles to the subject. The biological sample collected before the administration of the peptidomimetic macrocycle to the subject can be done within 0-24 hour before the start of administration of the peptidomimetic macrocycle to the subject. For example, the biological sample can be collected within 24 h, within 23 h, within 22 h, within 21 h, within 20 h, within 19 h, within 18 h, within 17 h, within 16 h, within 15 h, within 14 h, within 13 h, within 12 h, within 11 h, within 10 h, within 9 h, within 8 h, within 7 h, within 6 h, within 5 h, within 4 h, within 3 h, within 2 h, within 1 h, within 30 min, within 15 min, or immediately before the administration of the peptidomimetic macrocycle to the subject. One or more biological samples collected after the administration of the peptidomimetic macrocycle to the subject can be collected, for example after 0 min, 5 min, 10 min, 20 min, 30 min, 45 min, 60 min, 1.25 h, 1.5 h, 1.75 h, 2.0 h, 2.25 h, 2.5 h, 2.75 h, 3.0 h, 3.25 h, 3.5 h, 3.75 h, 4.0 h, 4.25 h, 4.5 h, 4.75 h, 5.0 h, 5.25 h, 5.5 h, 5.75 h, 6.0 h, 6.25 h, 6.5 h, 6.75 h, 7.0 h, 7.25 h, 7.5 h, 7.75 h, 8.0 h, 8.25 h, 8.5 h, 8.75 h, 9.0 h, 9.25 h, 9.5 h, 9.75 h, 10.0 h, 10.25 h, 10.5 h, 10.75 h, 11.0 h, 11.25 h, 11.5 h, 11.75 h, 12.0 h, 20 h, 24 h, 28 h, 32 h, 36 h, 40 h, 44 h, 48 h, 52 h, 56 h, 60 h, 64 h, 68 h, 72 h, or 0-72 h after the administration of the peptidomimetic macrocycle to the subject. In some embodiments, the peptidomimetic macrocycle is administered on day 1, day 8, day 15 of a 28 day cycle and biological sample is collected before administration on day 1, after the administration on day 1 (multiple biological samples can be collected, for example after about 0 min, about 30 min, about 1 h, about 2 h, about 4 h, about 8 h, about 24 h, and 48 hour after administration), before administration on day 8, after administration on day 8 (multiple biological samples can be collected, for example after about 0 min, about 30 min, about 1 h, about 2 h, and about 4 h after administration), before administration on day 15 and after administration on day 15 (multiple biological samples can be collected, for example after about 0 min, about 30 min, about 1 h, about 2 h, about 4 h, about 8 h, and about 24 h after administration). In some embodiments, the peptidomimetic macrocycle is administered on day 1, day 8, day 11 of a 21 day cycle and biological sample is collected before administration on day 1, after the administration on day 1 (multiple biological samples can be collected, for example after about 0 min, about 30 min, about 1 h, about 2 h, about 4 h, about 8 h, about 24 h, and 48 hour after administration), before administration on day 8, after administration on day 8 (multiple biological samples can be collected, for example after about 0 min, about 30 min, about 1 h, about 2 h, and about 4 h after administration), before administration on day 11 and after administration on day 11 (multiple biological samples can be collected, for example after about 0 min, about 30 min, about 1 h, about 2 h, about 4 h, about 8 h, and about 24 h after administration).

The method of the disclosure can optionally include pharmacodynamic analysis of the peptidomimetic macrocycles disclosed herein. Accordingly, the methods can comprise collecting one or more biological samples from the subject at one or more specific time points for pharmacodynamic analysis. Pharmacodynamic analysis can include analyzing the levels of biomarkers including MIC-1, p53, MDM2, MDMX, p21 and/or cases in the biological sample.

Detection of biomarkers in a biological sample can be performed by, for example, direct measurement, immunohistochemistry, immunoblotting, immunoflourescense, immunoabsorbence, immunoprecipitations, protein array, flourescence in situ hybridization, FACS analysis, hybridization, in situ hybridization, Northern blots, Southern blots, Western blots, ELISA, radioimmunoassay, gene array/chip, PCR, RT-PCR, or cytogenetic analysis. The biological sample for pharmacodynamic analysis can be a blood sample or a liquid cancer cell specimen from the subject, for example, a biological sample for pharmacodynamic analysis can be a blood sample or a liquid cancer cell specimen from the human subject. The biological samples for pharmacodynamic analysis of the peptidomimetic macrocycles can be collected any time before, during, or after the administration of the peptidomimetic macrocycle to the subject. In some embodiments a blood sample for pharmacokinetic analysis is collected before the first administration of the peptidomimetic macrocycle to the subject and at one or more time points after each administration of the peptidomimetic macrocycles to the subject. The blood sample collected before the administration of the peptidomimetic macrocycle to the subject can be done within 0-24 hour before the start of administration of the peptidomimetic macrocycle to the subject. For example, the biological sample can be collected within 24 h, within 23 h, within 22 h, within 21 h, within 20 h, within 19 h, within 18 h, within 17 h, within 16 h, within 15 h, within 14 h, within 13 h, within 12 h, within 11 h, within 10 h, within 9 h, within 8 h, within 7 h, within 6 h, within 5 h, within 4 h, within 3 h, within 2 h, within 1 h, within 30 min, within 15 min of, or immediately before the administration of the peptidomimetic macrocycle to the subject. One or more blood samples for pharmacodynamic analysis collected after the administration of the peptidomimetic macrocycle to the subject can be collected from 0-about 72 h, for example after about 12 h, after about 24 h, after about 36 h or after about 48 h after the administration of the peptidomimetic macrocycle to the subject. In some embodiments, the peptidomimetic macrocycle is administered on day 1, day 8, day 15 of a 28 day cycle and blood samples for pharmacodynamic analysis are collected before administration on day 1, after the administration on day 1 (multiple samples can be collected, for example after about 24 h and 48 hour after administration), before administration on day 8, after administration on day 8 (multiple samples can be collected, for example with about 1 h administration), before administration on day 15 and after administration on day 15 (multiple samples can be collected, for example with about 1 h and about 48 h after administration), and day 22. Biological samples for pharmacodynamic analysis can be collected at any time before, after or during the administration of the peptidomimetic macrocycle to the subject. For example the peptidomimetic macrocycle can be administered on day 1, day 8, day 15 of a 28 day cycle and liquid cancer cell samples for pharmacodynamic analysis are collected before administration on day 1 and between day 14-day 18, for example of day 16. In some embodiments, the peptidomimetic macrocycle is administered on day 1, day 8, day 11, of a 21 day cycle and blood samples for pharmacodynamic analysis are collected before administration on day 1, after the administration on day 1 (multiple samples can be collected, for example after about 24 h and 48 hour after administration), before administration on day 8, after administration on day 8 (multiple samples can be collected, for example with about 1 h administration), before administration on day 11 and after administration on day 11 (multiple samples can be collected, for example with about 1 h and about 48 h after administration), and day 22. Biological samples for pharmacodynamic analysis can be collected at any time before, after or during the administration of the peptidomimetic macrocycle to the subject. For example the peptidomimetic macrocycle can be administered on day 1, day 8, day 11 of a 21 day cycle and liquid cancer cell samples for pharmacodynamic analysis are collected before administration on day 1 and between day 10-day 14, for example of day 12.

The method of the disclosure can optionally include clinical activity analysis of the peptidomimetic macrocycles disclosed herein. Accordingly, the methods can comprise analyzing one or more biological samples collected from the subject at one or more specific time points. Any appropriate analytical procedure can be used for the analysis of the biological samples. For example, imaging techniques like radiographs, ultrasound, CT scan, PET scan, MRI scan, chest x-ray, laparoscopy, complete blood count (CBC) test, bone scanning and fecal occult blood test can be used. Further analytical procedures that can be used include blood chemistry analysis, chromosomal translocation analysis, needle biopsy, tissue biopsy, fluorescence in situ hybridization, laboratory biomarker analysis, immunohistochemistry staining method, flow cytometry, or a combination thereof. The method can further comprise tabulating and/or plotting results of the analytical procedure.

For example, pharmacodynamics can be assessed by laboratory-based evaluation of several biomarkers of p53 activation, including levels of p21, caspase and MDM2 in liquid cancer cell tissue, and where available in CTC, as well as MIC-1 in blood, before and after treatment with the peptidomimetic macrocycles.

Results available from previous genetic and biomarker tests, and additional tests of the blood and t liquid cancer cell samples for biomarkers relevant to the safety and efficacy of the peptidomimetic macrocycles can be investigated for possible correlation with patient outcome.

For example, clinical activity or response can be evaluated by standard imaging assessments, such as computed tomography (CT), magnetic resonance imaging (MRI), and bone scans. In addition, [$^{18}$F]-fluorodeoxyglucose and [$^{18}$F]-fluorothymidine positron emission tomography (FDG-PET and FLT-PET, respectively), or other techniques considered clinically appropriate for the patient's specific disease type can be used. CT-imaging can be performed, for example, at the end of Cycle 2, and every 2 cycles (e.g., Cycles 4 and 6) thereafter for DR-A and after the last infusion in Cycle 3 and every 3 cycles (e.g., Cycles 6 and 9) thereafter in DR-B. Anti-liquid cancer cell activity can be assessed using IWG (2014) (Appendix H) criteria for patients with liquid lymphomas. Additionally, for patients with an FDG-avid liquid lymphoma, FDG-PET imaging can be performed at baseline and post-baseline as outlined in IWG 2014. FLT-PET imaging can be performed at baseline for patients with liquid cancer cell commonly showing sufficient uptake of FLT tracer, e.g., patients with liquid lymphoma. For example, DR-A assigned patients who demonstrate a standard uptake value (SUV) of ≥5 at baseline can have a repeat FLT image one day after their last infusion of study medication in Cycle 1, i.e., Day 16. For example, DR-B patients who demonstrate a standard uptake value (SUV) of ≥5 at baseline can have a repeat FLT image one day after their last infusion of study medication in Cycle 1, i.e., Day 12.

Biological Samples

As used in the present application, "biological sample" means any fluid or other material derived from the body of a normal or diseased subject, such as blood, serum, plasma, lymph, urine, saliva, tears, cerebrospinal fluid, milk, amniotic fluid, bile, ascites fluid, pus, and the like. Also included within the meaning of the term "biological sample" is an organ or tissue extract and culture fluid in which any cells or tissue preparation from a subject has been incubated. Biological samples also include liquid cancer cell samples or specimens. Liquid cancer cell sample can be a liquid cancer cell tissue sample. In some embodiments, the liquid cancer cell tissue sample can obtained from surgically excised tissue. Tissue samples and cellular samples can also be obtained without invasive surgery, for example by punctuating the chest wall or the abdominal wall or from masses of breast, thyroid or other sites with a fine needle and withdrawing cellular material (fine needle aspiration biopsy). In some embodiments, a biological sample is a bone marrow aspirate sample.

The biological samples obtained can be used in fresh, frozen, or fixed (e.g., paraffin-embedded) form, depending on the nature of the sample, the assay used, and the convenience of the practitioner. Although fresh, frozen and fixed materials are suitable for various RNA and protein assays, generally, fresh tissues can be preferred for ex vivo measurements of activity.

Fixed tissue samples can also be employed. Tissue obtained by biopsy is often fixed, usually by formalin, formaldehyde, or gluteraldehyde, for example, or by alcohol immersion. Fixed biological samples are often dehydrated and embedded in paraffin or other solid supports. See the reference Plenat et al., 2001, *Ann. Pathol.* 21:29-47. Non-embedded, fixed tissue, as well as fixed and embedded tissue, can be used in the present methods. Solid supports for embedding fixed tissue can be removed with organic solvents to enable subsequent rehydration of preserved tissue.

In some cases, the assay includes a step of cell or tissue culture. For example, cells from a biopsy can be disaggregated using enzymes (such as collagenase and hyaluronidase) and or physical disruption (e.g., repeated passage through a 25-gauge needle) to dissociate the cells, collected by centrifugation, and resuspended in desired buffer or culture medium for culture, immediate analysis, or further processing.

Subject/Patient Population

In some embodiments, a subject treated for liquid cancer in accordance with the methods provided herein is a human, who has or is diagnosed with a liquid cancer. In other embodiments, a subject treated for liquid cancer in accordance with the methods provided herein is a human, predisposed or susceptible to a liquid cancer. In some embodiments, a subject treated for liquid cancer in accordance with the methods provided herein is a human, at risk of developing a liquid cancer.

In some embodiments, a subject treated for liquid cancer in accordance with the methods provided herein is a human, who has or is diagnosed with a liquid cancer, determined to lack a p53 deactivating mutation and/or expressing wild type p53. In other embodiments, a subject treated for liquid cancer in accordance with the methods provided herein is a human, predisposed or susceptible to a liquid cancer, determined to lack a p53 deactivating mutation and/or expressing wild type p53. In some embodiments, a subject treated for liquid cancer in accordance with the methods provided herein is a human, at risk of developing a liquid cancer, determined to lack a p53 deactivating mutation and/or expressing wild type p53. A p53 deactivating mutation, as used herein is any mutation that leads to loss of (or a decrease in) the in vitro apoptotic activity of p53. Non limiting examples of p53 deactivating mutations are included in Table 1. Accordingly, in some embodiments, a subject with a liquid cancer in accordance with the composition as provided herein is a human who has or is diagnosed with a liquid cancer that is determined to lack a p53 deactivation mutation, such as those shown in Table 1.

In some embodiments, a subject treated for liquid cancer in accordance with the methods provided herein is a human, who has or is diagnosed with a liquid cancer, determined to lack a dominant p53 deactivating mutation. Dominant p53 deactivating mutation or dominant negative mutation, as used herein, is a mutation wherein the mutated p53 inhibits or disrupt the activity of the wild-type p53 gene.

TABLE 1

Examples of p53 deactivating mutations

| Mutation at position | Amino acid change |
|---|---|
| 62 | E62_W91del |
| 122 | V122X |
| 135 | C135S |
| 143 | V143A |
| 144 | Q144P |
| 146 | W146X |
| 157 | V157F |
| 158 | R158H |
| 163 | Y163N |
| 168 | H168Y |
| 173 | V173L |
| 175 | R175H |
| 175 | R175P |
| 175 | R175Q |
| 175 | R175S |
| 219 | P219H |
| 234 | Y234C |
| 234 | Y234H |
| 237 | M237I |
| 240 | S240R |
| 245 | G245C |
| 245 | G245S |
| 246 | M246I |
| 248 | R248Q |
| 248 | R248W |
| 249 | R249S |
| 272 | V272M |
| 273 | R273H |
| 274 | V274F |
| 279 | G279E |
| 280 | R280K |
| 281 | D281H |
| 282 | R282W |
| 306 | R306P |
| 308 | P300_L308del |
| 327 | P300_Y327del |
| 332 | D324_I332del |
| 337 | R337C |
| 344 | L344P |

Table 1 refers to the sequence of the wild-type human TP53 tumor protein p53 shown in FIG. 1. Amino acid changes are reported as: the amino acid being substituted followed by the position of the amino acid being substituted in the wild type p53 sequence, followed by the amino acid used for substitution. For example L344P, indicates that the leucine residue (L) at the 344 position in the wild type sequence is replaced by a proline residue (P).

In some embodiments, a subject treated for liquid cancer in accordance with the methods provided herein is a refractory patient. In a certain embodiment, a refractory patient is a patient refractory to a standard therapy (e.g., surgery, radiation, anti-androgen therapy and/or drug therapy such as chemotherapy). In certain embodiments, a patient with the liquid cancer is refractory to a therapy when the liquid cancer has not significantly been eradicated and/or the one or more symptoms have not been significantly alleviated. The determination of whether a patient is refractory can be made either in vivo or in vitro by any method known in the art for assaying the effectiveness of a treatment of liquid cancer. In various embodiments, a patient with liquid cancer is refractory when the number of CTCs or MNBCs associated with the liquid cancer have not decreased or have increased. In various embodiments, a patient with liquid cancer is refractory when one or more liquid cancer cells metastasize and/or spread to another organ.

In some embodiments, a subject treated for liquid cancer in accordance with the methods provided herein is a human that has proven refractory to therapies other than treatment with the peptidomimetic macrocycles of the disclosure, but is no longer on these therapies. In certain embodiments, a subject treated for liquid cancer in accordance with the methods provided herein is a human already receiving one or more conventional anti-cancer therapies, such as surgery, drug therapy such as chemotherapy, anti-androgen therapy or radiation. Among these patients are refractory patients, patients who are too young for conventional therapies, and patients with recurring liquid cancer cells despite treatment with existing therapies.

In some embodiments, the subject is a human who has had at least one unsuccessful prior treatment and/or therapy of the liquid cancer.

Methods of Detecting Wild Type p53 and/or p53 Mutations

The liquid cancer cell samples from a subject can be assayed in order to determine the lack of a p53 deactivating mutation and/or expression of wild type p53.

In order to detect the p53 wild-type gene and/or lack of p53 deactivation mutation in a tissue, it can be helpful to isolate the tissue free from surrounding normal tissues. For example, the tissue can be isolated from paraffin or cryostat sections. Cancer cells can also be separated from normal cells by flow cytometry. If the liquid cancer cells tissue is highly contaminated with normal cells, detection of mutations can be more difficult.

Detection of point mutations can be accomplished by molecular cloning of the p53 allele (or alleles) present in the liquid cancer cell tissue and sequencing that allele(s). Alternatively, the polymerase chain reaction can be used to amplify p53 gene sequences directly from a genomic DNA preparation from the liquid cancer cell tissue. The DNA sequence of the amplified sequences can then be determined. See e.g., Saiki et al., Science, Vol. 239, p. 487, 1988; U.S. Pat. No. 4,683,202; and 4,683,195.

Specific deletions of p53 genes can also be detected. For example, restriction fragment length polymorphism (RFLP) probes for the p53 gene or surrounding marker genes can be used to score loss of a p53 allele.

Loss of wild-type p53 genes can also be detected on the basis of the loss of a wild-type expression product of the p53 gene. Such expression products include both the mRNA as well as the p53 protein product itself. Point mutations can be detected by sequencing the mRNA directly or via molecular cloning of cDNA made from the mRNA. The sequence of the cloned cDNA can be determined using DNA sequencing techniques. The cDNA can also be sequenced via the polymerase chain reaction (PCR).

Alternatively, mismatch detection can be used to detect point mutations in the p53 gene or its mRNA product. The method can involve the use of a labeled riboprobe which is complementary to the human wild-type p53 gene. The riboprobe and either mRNA or DNA isolated from the liquid cancer cell tissue are annealed (hybridized) together and subsequently digested with the enzyme RNase A which is able to detect some mismatches in a duplex RNA structure. If a mismatch is detected by RNase A, it cleaves at the site of the mismatch. Thus, when the annealed RNA preparation is separated on an electrophoretic gel matrix, if a mismatch has been detected and cleaved by RNase A, an RNA product will be seen which is smaller than the full-length duplex RNA for the riboprobe and the p53 mRNA or DNA. The riboprobe need not be the full length of the p53 mRNA or gene but can be a segment of either. If the riboprobe comprises only a segment of the p53 mRNA or gene it will be desirable to use a number of these probes to screen the whole mRNA sequence for mismatches.

In similar fashion, DNA probes can be used to detect mismatches, through enzymatic or chemical cleavage. See, e.g., Cotton et al., Proc. Natl. Acad. Sci. USA, vol. 85, 4397, 1988; and Shenk et al., Proc. Natl. Acad. Sci. USA, vol. 72, p. 989, 1975. Alternatively, mismatches can be detected by shifts in the electrophoretic mobility of mismatched duplexes relative to matched duplexes. See, e.g., Cariello, Human Genetics, vol. 42, p. 726, 1988. With either riboprobes or DNA probes, the cellular mRNA or DNA which might contain a mutation can be amplified using PCR (see below) before hybridization.

DNA sequences of the p53 gene from the liquid cancer cell tissue which have been amplified by use of polymerase chain reaction can also be screened using allele-specific probes. These probes are nucleic acid oligomers, each of which contains a region of the p53 gene sequence harboring a known mutation. For example, one oligomer can be about 30 nucleotides in length, corresponding to a portion of the p53 gene sequence. At the position coding for the 175th codon of p53 gene the oligomer encodes an alanine, rather than the wild-type codon valine. By use of a battery of such allele-specific probes, the PCR amplification products can be screened to identify the presence of a previously identified mutation in the p53 gene. Hybridization of allele-specific probes with amplified p53 sequences can be performed, for example, on a nylon filter. Hybridization to a particular probe indicates the presence of the same mutation in the liquid cancer cell tissue as in the allele-specific probe.

The identification of p53 gene structural changes in liquid cancer cells can be facilitated through the application of a diverse series of high resolution, high throughput microarray platforms. Essentially there are two types of array; those that carry PCR products from cloned nucleic acids (e.g. cDNA, BACs, cosmids) and those that use oligonucleotides. The methods can provide a way to survey genome wide DNA copy number abnormalities and expression levels to allow correlations between losses, gains and amplifications in liquid cancer cells with genes that are over- and under-expressed in the same samples. The gene expression arrays that provide estimates of mRNA levels in liquid cancer cells have given rise to exon-specific arrays that can identify both gene expression levels, alternative splicing events and mRNA processing alterations. Oligonucleotide arrays are also being used to interrogate single nucleotide polymorphisms (SNPs) throughout the genome for linkage or association studies and these have been adapted to quantify copy number abnormalities and loss of heterozygosity events. DNA sequencing arrays can allow resequencing of chromosome regions and whole genomes.

SNP-based arrays or other gene arrays or chips are also contemplated to determine the presence of wild-type p53 allele and the structure of mutations. A single nucleotide polymorphism (SNP), a variation at a single site in DNA, is the most frequent type of variation in the genome. For example, there are an estimated 5-10 million SNPs in the human genome. As SNPs are highly conserved throughout evolution and within a population, the map of SNPs serves as an excellent genotypic marker for research. SNP array is a useful tool to study the whole genome.

In addition, SNP array can be used for studying the Loss Of Heterozygosity (LOH). LOH is a form of allelic imbalance that can result from the complete loss of an allele or from an increase in copy number of one allele relative to the other. While other chip-based methods (e.g., comparative genomic hybridization can detect only genomic gains or deletions), SNP array has the additional advantage of detecting copy number neutral LOH due to uniparental disomy (UPD). In UPD, one allele or whole chromosome from one parent are missing leading to reduplication of the other parental allele (uni-parental=from one parent, disomy=duplicated). In a disease setting this occurrence can be pathologic when the wild-type allele (e.g., from the mother) is missing and instead two copies of the heterozygous allele (e.g., from the father) are present. This usage of SNP array has a huge potential in cancer diagnostics as LOH is a prominent characteristic of most human cancers. SNP array technology have shown that not only liquid cancers (e.g. gastric cancer, liver cancer etc) but also hematologic malignancies (ALL, MDS, CML etc) have a high rate of LOH due to genomic deletions or UPD and genomic gains. In the present disclosure, using high density SNP array to detect LOH allows identification of pattern of allelic imbalance to determine the presence of wild-type p53 allele (Lips et ah, 2005; Lai et al, 2007).

Examples for current p53 gene sequence and single nucleotide polymorphism arrays include p53 Gene Chip (Affymetrix, Santa Clara, Calif.), Roche p53 Ampli-Chip (Roche Molecular Systems, Pleasanton, Calif.), GeneChip Mapping arrays (Affymetrix, Santa Clara, Calif.), SNP Array 6.0 (Affymetrix, Santa Clara, Calif.), BeadArrays (Illumina, San Diego, Calif.), etc.

Mutations of wild-type p53 genes can also be detected on the basis of the mutation of a wild-type expression product of the p53 gene. Such expression products include both the mRNA as well as the p53 protein product itself. Point mutations can be detected by sequencing the mRNA directly or via molecular cloning of cDNA made from the mRNA. The sequence of the cloned cDNA can be determined using DNA sequencing techniques. The cDNA can also be sequenced via the polymerase chain reaction (PCR). A panel of monoclonal antibodies could be used in which each of the epitopes involved in p53 functions are represented by a monoclonal antibody. Loss or perturbation of binding of a monoclonal antibody in the panel can indicate mutational alteration of the p53 protein and thus of the p53 gene itself. Mutant p53 genes or gene products can also be detected in body samples, such as, serum, stool, or other body fluids, such as urine and sputum. The same techniques discussed above for detection of mutant p53 genes or gene products in tissues can be applied to other body samples.

Loss of wild-type p53 genes can also be detected by screening for loss of wild-type p53 protein function. Although all of the functions which the p53 protein undoubtedly possesses have yet to be elucidated, at least two specific functions are known. Protein p53 binds to the SV40 large T antigen as well as to the adenovirus EIB antigen. Loss of the ability of the p53 protein to bind to either or both of these antigens indicates a mutational alteration in the protein which reflects a mutational alteration of the gene itself. Alternatively, a panel of monoclonal antibodies could be used in which each of the epitopes involved in p53 functions are represented by a monoclonal antibody. Loss or perturbation of binding of a monoclonal antibody in the panel would indicate mutational alteration of the p53 protein and thus of the p53 gene itself. Any means for detecting an altered p53 protein can be used to detect loss of wild-type p53 genes.

Mutant p53 genes or gene products can also be detected in body samples, such as, serum, stool, or other body fluids, such as urine and sputum. The same techniques discussed above for detection of mutant p53 genes or gene products in tissues can be applied to other body samples.

Determination of the lack of p53 deactivating mutation and/or expression of wild type p53 in the subject with liquid cancer can be performed any time before, during or after the administration of the peptidomimetic macrocycles. In some embodiments, the determination of the lack of a p53 deactivating mutation and/or expression of wild type p53 is performed before the first administration of the peptidomimetic macrocycle to the subject, for example about 5 years-about 1 month, about 4 years-about 1 month, about 3 years-1 month, about 2 years-about 1 month, about 1 years-about 1 month, about 5 years-about 1 week, about 4 years-about 1 week, about 3 years-about 1 month, about 2 years-about 1 week, about 1 year-about 1 week, about 5 years-about 1 day, about 4 years-about 1 day, about 3 years-about 1 day, about 2 years-about 1 day, about 1 year-about 1 day, about 15 months-about 1 month, about 15 months-about 1 week, about 15 months-about 1 day, about 12 months-about 1 month, about 12 months-about 1 week, about 12 months-about 1 day, about 6 months-1 about month, about 6 months-about 1 week, about 6 months-about 1 day, about 3 months-1 about month, about 3 months-about 1 week, or about 3 months-about 1 day prior to the first administration of the peptidomimetic macrocycle to the subject. In some examples, the confirmation of the lack of the p53 deactivating mutation and/or expression of wild type p53 is performed up to 6 years, 5 years, 4 years, 3 years, 24 months, 23 months, 22 months, 21 months, 20 months, 19 months, 18 months, 17 months, 16 months, 15 months, 14 months, 13 months, 12 months, 11 months, 10 months, 9 months, 8 months, 7 months, 6 months, 5 months, 4 months, 3 months, 2 months, 1 months, 4 weeks (28 days), 3 weeks (21 days), 2 weeks (14 days), 1 week (7 days), 6 days, 5 days, 4 days, 3 days, 2 days or 1 day before the first administration of the peptidomimetic macrocycle to the subject. In some examples the confirmation of the lack of the p53 deactivating mutation is performed within 1 month of the first administration of the peptidomimetic macrocycle to the subject. In some examples the confirmation of the lack of the p53 deactivating mutation is performed within 21 days of the first administration of the peptidomimetic macrocycle to the subject.

Liquid Cancers

Liquid cancers that can be treated by the instant methods include, but are not limited to, liquid lymphomas, lekemias, and myelomas. Examples of liquid lymphomas and leukemias that can be treated in accordance with the methods described include, but are not limited to, chronic lymphocytic leukemia/small lymphocytic lymphoma, B-cell prolymphocytic leukemia, lymphoplasmacytic lymphoma (such as waldenström macroglobulinemia), splenic marginal zone lymphoma, plasma cell myeloma, plasmacytoma, monoclonal immunoglobulin deposition diseases, heavy chain diseases, extranodal marginal zone B cell lymphoma, also called malt lymphoma, nodal marginal zone B cell lymphoma (nmzl), follicular lymphoma, mantle cell lymphoma, diffuse large B cell lymphoma, mediastinal (thymic) large B cell lymphoma, intravascular large B cell lymphoma, primary effusion lymphoma, burkitt lymphoma/leukemia, T cell prolymphocytic leukemia, T cell large granular lymphocytic leukemia, aggressive NK cell leukemia, adult T cell leukemia/lymphoma, extranodal NK/T cell lymphoma, nasal type, enteropathy-type T cell lymphoma, hepatosplenic T cell lymphoma, blastic NK cell lymphoma, mycosis fungoides/sezary syndrome, primary cutaneous CD30-positive T cell lymphoproliferative disorders, primary cutaneous anaplastic large cell lymphoma, lymphomatoid papulosis, angioimmunoblastic T cell lymphoma, peripheral T cell lymphoma, unspecified, anaplastic large cell lymphoma, classical Hodgkin lymphomas (nodular sclerosis, mixed cellularity, lymphocyte-rich, lymphocyte depleted or not depleted), and nodular lymphocyte-predominant Hodgkin lymphoma.

Examples of liquid cancers that can be treated by the methods of the disclosure include cancers involving hyperplastic/neoplastic cells of hematopoietic origin, e.g., arising from myeloid, lymphoid or erythroid lineages, or precursor cells thereof. Examples of disorders include: acute leukemias, e.g., erythroblastic leukemia and acute megakaryoblastic leukemia. Additional exemplary myeloid disorders include, but are not limited to, acute promyeloid leukemia (APML), acute myelogenous leukemia (AML) and chronic myelogenous leukemia (CML) (reviewed in Vaickus, L. (1991) Crit Rev. in Oncol./Hemotol. 11:267-97); lymphoid malignancies include, but are not limited to acute lymphoblastic leukemia (ALL) which includes B-lineage ALL and T-lineage ALL, chronic lymphocytic leukemia (CLL), prolymphocytic leukemia (PLL), multiple mylenoma, hairy cell leukemia (HLL) and Waldenstrom's macroglobulinemia (WM). Additional forms of malignant lymphomas include, but are not limited to non-Hodgkin lymphoma and variants thereof, peripheral T cell lymphomas, adult T cell leukemia/lymphoma (ATL), cutaneous T-cell lymphoma (CTCL), large granular lymphocytic leukemia (LGF), Hodgkin's disease and Reed-Sternberg disease. For example, liquid cancers include, but are not limited to, acute lymphocytic leukemia (ALL); T-cell acute lymphocytic leukemia (T-ALL); anaplastic large cell lymphoma (ALCL); chronic myelogenous leukemia (CML); acute myeloid leukemia (AML); chronic lymphocytic leukemia (CLL); B-cell chronic lymphocytic leukemia (B-CLL); diffuse large B-cell lymphomas (DLBCL); hyper eosinophilia/chronic eosinophilia; and Burkitt's lymphoma.

In some embodiments, the liquid cancer treated by the methods of the disclosure is an acute lymphoblastic leukemia; acute myeloid leukemia; AIDS-related cancers; AIDS-related lymphoma; chronic lymphocytic leukemia; chronic myelogenous leukemia; chronic myeloproliferative disorders; cutaneous T-cell lymphoma; Hodgkin lymphoma; multiple myeloma; multiple myeloma/plasma cell neoplasm; Non-Hodgkin lymphoma; primary central nervous system (CNS) lymphoma; or T-cell lymphoma; In various embodiments, the liquid cancer can be B-Cell Chronic Lymphocytic Leukemia, B-Cell Lymphoma-DLBCL, B-Cell Lymphoma-DLBCL-germinal center-like, B-Cell Lymphoma-DLBCL-activated B-cell-like, or Burkitt's lymphoma.

In some embodiments liquid cancers treated by the methods disclosed herein exclude cancers that are known to be associated with HPV (Human papillomavirus).

The effectiveness and/or response of cancer treatment by the methods disclosed herein can be determined by any suitable method. The response can be a complete response, and which can be an objective response, a clinical response, or a pathological response to treatment. For example, the response can be determined based upon the techniques for evaluating response to treatment of liquid cancers as described in or by Revised International Working Group Response Criteria for liquid lymphoma patients (IWG 2014), which is hereby incorporated by reference in its entirety. The response can be a duration of survival (or probability of such duration) or progression-free interval. The timing or duration of such events can be determined from about the time of diagnosis, or from about the time treatment is initiated or from about the time treatment is finished (like the final administration of the peptidomimetic macrocycle). Alternatively, the response can be based upon a reduction in the number of liquid cancer cells, the number of liquid cancer cells per unit volume, or liquid cancer cell metabolism, or based upon overall liquid cancer cell burden, or based upon levels of serum markers especially where elevated in the disease state.

The response in individual patients can be characterized as a complete response, a partial response, stable disease, and progressive disease. In some embodiments, the response is complete response (CR). Complete response can be defined as disappearance of all circulating tumor cells (CTC) or a mononuclear blood cells (MNBC) i.e. any pathological lymph nodes (whether target or non-target) must have reduction in short axis to <10 mm. In some examples (e.g., AML), complete response can be defined as the following: bone marrow blasts <5%; absence of blasts with Auer rods; absence of extramedullary disease; absolute neutrophil count >1.0×109/L (1000/μL); platelet count >100×109/L (100 000/μL); and independence of red cell transfusions. In certain embodiments, the response is a CR with Incomplete Recovery (CRi). CR with Incomplete Recovery, in some examples (e.g., AML), can be defined to include all CR criteria except for residual neutropenia (<1.0×109/L [1000/μL]) or thrombocytopenia (<100 x 109/L [100 000/μL]). In certain embodiments, the response is a morphologic leukemia free state. Morphologic leukemia free state, in some examples (e.g., AML), can be defined to include bone marrow blasts <5%; absence of blasts with Auer rods; absence of extramedullary disease; and no hematologic recovery required. In certain embodiments, the response is a partial response (PR). Partial response can be defined to mean at least 30% decrease in the sum of diameters of circulating tumor cells (CTC) or a mononuclear blood cells (MNBC), taking as reference the baseline sum diameters. In some examples (e.g., AML), partial response can be defined to include all hematologic criteria of CR; decrease of bone marrow blast percentage to 5% to 25%; and decrease of pretreatment bone marrow blast percentage by at least 50%. In certain embodiments, the response is a morphologic leukemia free state. Morphologic leukemia free state, in some examples (e.g., AML), can be defined to include bone marrow blasts <5%; absence of blasts with Auer rods; absence of extramedullary disease; and no hematologic recovery required. In certain embodiments, the response is a relapse. Relapse, in some examples (e.g., AML), can be defined to include bone marrow blasts <5%; absence of blasts with Auer rods; absence of extramedullary disease; and no hematologic recovery required. In some embodiments, the response is progressive disease (PD). Progressive disease can be defined as at least a 20% increase in the number of circulating tumor cells (CTC) or a mononuclear blood cells (MNBC), taking as reference the smallest number on study (this includes the baseline number if that is the smallest) and an absolute increase of at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 30, at least 40, at least 50, or at least 100 or more circulating tumor cells (CTC) or a mononuclear blood cells (MNBC). The appearance of one or more new lesions can also be considered as progression. In some embodiments, the disease can be stable disease (SD). Stable disease can be characterized by neither sufficient decrease in liquid cancer cell number to qualify for PR nor sufficient increase to qualify for PD, taking as reference the smallest number of CTCs and/or MNBCs while on study. In certain embodiments, the response is a pathological complete response. A pathological complete response, e.g., as determined by a pathologist following examination of tissue removed at the time of surgery or biopsy, generally refers to an absence of histological evidence of invasive and/or non-invasive liquid cancer cells in the surgical specimen.

Combination Treatment

Also provided herein are combination therapies for the treatment of a liquid cancer which involve the administration of the peptidomimetic macrocycles disclosed herein in combination with one or more additional therapies to a subject with liquid cancer determined to lack a p53 deactivating mutation and/or express wild type p53. In a specific embodiment, presented herein are combination therapies for the treatment of liquid cancer which involve the administration of an effective amount of the peptidomimetic macrocycles in combination with an effective amount of another therapy to a subject with a liquid cancer determined to lack a p53 deactivating mutation and/or with a liquid cancer expressing wild type p53.

As used herein, the term "in combination," refers, in the context of the administration of the peptidomimetic macrocycles, to the administration of the peptidomimetic macrocycles prior to, concurrently with, or subsequent to the administration of one or more additional therapies (e.g., agents, surgery, or radiation) for use in treating liquid cancer. The use of the term "in combination" does not restrict the order in which the peptidomimetic macrocycles and one or more additional therapies are administered to a subject. In specific embodiments, the interval of time between the administration of the peptidomimetic macrocycles and the administration of one or more additional therapies can be about 1-about 5 minutes, about 1-about 30 minutes, about 30 minutes to about 60 minutes, about 1 hour, about 1-about 2 hours, about 2-about 6 hours, about 2-about 12 hours, about 12-about 24 hours, about 1-about 2 days, about 2 days, about 3 days, about 4 days, about 5 days, about 6 days, about 7 days, about 1 week, about 2 weeks, about 3 weeks, about 4 weeks, about 5 weeks, about 6 weeks, about 7 weeks, about 8 weeks, about 9 weeks, about 10 weeks, about 15 weeks, about 20 weeks, about 26 weeks, about 52 weeks, about 11-about 15 weeks, about 15-about 20 weeks, about 20-about 30 weeks, about 30-about 40 weeks, about 40-about 50 weeks, about 1 month, about 2 months, about 3 months, about 4 months, about 5 months, about 6 months, about 7 months, about 8 months, about 9 months, about 10 months, about 11 months, about 12 months, about 1 year, about 2 years, or any period of time in between. In certain embodiments, the peptidomimetic macrocycles and one or more additional therapies are administered less than 1 day, less than 1 week, less than 2 weeks, less than 3 weeks, less than 4 weeks, less than one month, less than 2 months, less than 3 months, less than 6 months, less than 1 year, less than 2 years, or less than 5 years apart.

In some embodiments, the combination therapies provided herein involve administering of the peptidomimetic macrocycles 1-2 times a week, once every week, once every 2 weeks, once every 3 weeks, once every 4 weeks, once every 5 weeks, once every 6 weeks, once every 7 weeks or once every 8 weeks and administering one or more additional therapies once a week, once every 2 weeks, once every 3 weeks, once every 4 weeks, once every month, once every 2 months (e.g., approximately 8 weeks), once every 3 months (e.g., approximately 12 weeks), or once every 4 months (e.g., approximately 16 weeks). In certain embodiments, the peptidomimetic macrocycles and one or more additional therapies are cyclically administered to a subject. Cycling therapy involves the administration of the peptidomimetic macrocycles compounds for a period of time, followed by the administration of one or more additional therapies for a period of time, and repeating this sequential administration. In certain embodiments, cycling therapy can also include a period of rest where the peptidomimetic macrocycles or the additional therapy is not administered for a period of time (e.g., 2 days, 3 days, 4 days, 5 days, 6 days, 7 days, 1 week, 2 weeks, 3 weeks, 4 weeks, 5 weeks, 10 weeks, 20 weeks, 1 month, 2 months, 3 months, 4 months, 5 months, 6 months, 7 months, 8 months, 9 months, 10 months, 11 months, 12 months, 2 years, or 3 years). In an embodiment, the number of cycles administered is from 1 to 12 cycles, from 2 to 10 cycles, or from 2 to 8 cycles.

In some embodiments, the methods for treating liquid cancer provided herein comprise administering the peptidomimetic macrocycles as a single agent for a period of time prior to administering the peptidomimetic macrocycles in combination with an additional therapy. In certain embodiments, the methods for treating cancer provided herein comprise administering an additional therapy alone for a period of time prior to administering the peptidomimetic macrocycles in combination with the additional therapy.

In some embodiments, the administration of the peptidomimetic macrocycles and one or more additional therapies in accordance with the methods presented herein have an additive effect relative the administration of the peptidomimetic macrocycles or said one or more additional therapies alone. In some embodiments, the administration of the peptidomimetic macrocycles and one or more additional therapies in accordance with the methods presented herein have a synergistic effect relative to the administration of the peptidomimetic macrocycles or said one or more additional therapies alone.

As used herein, the term "synergistic," refers to the effect of the administration of the peptidomimetic macrocycles in combination with one or more additional therapies (e.g., agents), which combination is more effective than the additive effects of any two or more single therapies (e.g., agents). In a specific embodiment, a synergistic effect of a combination therapy permits the use of lower dosages (e.g., sub-optimal doses) of the peptidomimetic macrocycles or an additional therapy and/or less frequent administration of the peptidomimetic macrocycles or an additional therapy to a subject. In certain embodiments, the ability to utilize lower dosages of the peptidomimetic macrocycles or of an additional therapy and/or to administer the peptidomimetic macrocycles or said additional therapy less frequently reduces the toxicity associated with the administration of the peptidomimetic macrocycles or of said additional therapy, respectively, to a subject without reducing the efficacy of the peptidomimetic macrocycles or of said additional therapy, respectively, in the treatment of liquid cancer. In some embodiments, a synergistic effect results in improved efficacy of the peptidomimetic macrocycles and each of said additional therapies in treating cancer. In some embodiments, a synergistic effect of a combination of the peptidomimetic macrocycles and one or more additional therapies avoids or reduces adverse or unwanted side effects associated with the use of any single therapy.

The combination of the peptidomimetic macrocycles and one or more additional therapies can be administered to a subject in the same pharmaceutical composition. Alternatively, the peptidomimetic macrocycles and one or more additional therapies can be administered concurrently to a subject in separate pharmaceutical compositions. The peptidomimetic macrocycles and one or more additional therapies can be administered sequentially to a subject in separate pharmaceutical compositions. The peptidomimetic macrocycles compounds and one or more additional therapies can also be administered to a subject by the same or different routes of administration.

The combination therapies provided herein involve administering to a subject to in need thereof the peptidomimetic macrocycles in combination with conventional, or known, therapies for treating cancer. Other therapies for cancer or a condition associated therewith are aimed at controlling or relieving one or more symptoms. Accordingly, in some embodiments, the combination therapies provided herein involve administering to a subject to in need thereof a pain reliever, or other therapies aimed at alleviating or controlling one or more symptoms associated with or a condition associated therewith.

Non-limiting specific examples of anti-cancer agents that can be used in combination with the peptidomimetic macrocycles include: a hormonal agent (e.g., aromatase inhibitor, selective estrogen receptor modulator (SERM), and estrogen receptor antagonist), chemotherapeutic agent (e.g., microtubule disassembly blocker, antimetabolite, topoisomerase inhibitor, and DNA crosslinker or damaging agent), anti-antigenic agent (e.g., VEGF antagonist, receptor antagonist, integrin antagonist, vascular targeting agent (VTA)/vascular disrupting agent (VDA)), radiation therapy, and conventional surgery.

Non-limiting examples of hormonal agents that can be used in combination with the peptidomimetic macrocycles include aromatase inhibitors, SERMs, and estrogen receptor antagonists. Hormonal agents that are aromatase inhibitors can be steroidal or no steroidal. Non-limiting examples of no steroidal hormonal agents include letrozole, anastrozole, aminoglutethimide, fadrozole, and vorozole. Non-limiting examples of steroidal hormonal agents include aromasin (exemestane), formestane, and testolactone. Non-limiting examples of hormonal agents that are SERMs include tamoxifen (branded/marketed as Nolvadex®), afimoxifene, arzoxifene, bazedoxifene, clomifene, femarelle, lasofoxifene, ormeloxifene, raloxifene, and toremifene. Non-limiting examples of hormonal agents that are estrogen receptor antagonists include fulvestrant. Other hormonal agents include but are not limited to abiraterone and lonaprisan.

Non-limiting examples of chemotherapeutic agents that can be used in combination with of peptidomimetic macrocycles include microtubule disassembly blocker, antimetabolite, topoisomerase inhibitor, and DNA crosslinker or damaging agent. Chemotherapeutic agents that are microtubule disassembly blockers include, but are not limited to, taxanes (e.g., paclitaxel (branded/marketed as TAXOL®), docetaxel, abraxane, larotaxel, ortataxel, and tesetaxel); epothilones (e.g., ixabepilone); and vinca alkaloids (e.g., vinorelbine, vinblastine, vindesine, and vincristine (branded/marketed as ONCOVIN®)).

Chemotherapeutic agents that are antimetabolites include, but are not limited to, folate anitmetabolites (e.g., methotrexate, aminopterin, pemetrexed, raltitrexed); purine antimetabolites (e.g., cladribine, clofarabine, fludarabine, mercaptopurine, pentostatin, thioguanine); pyrimidine antimetabolites (e.g., 5-fluorouracil, capcitabine, gemcitabine (GEMZAR®), cytarabine, decitabine, floxuridine, tegafur); and deoxyribonucleotide antimetabolites (e.g., hydroxyurea).

Chemotherapeutic agents that are topoisomerase inhibitors include, but are not limited to, class I (camptotheca) topoisomerase inhibitors (e.g., topotecan (branded/marketed as HYCAMTIN®) irinotecan, rubitecan, and belotecan); class II (podophyllum) topoisomerase inhibitors (e.g., etoposide or VP-16, and teniposide); anthracyclines (e.g., doxorubicin, epirubicin, Doxil, aclarubicin, amrubicin, daunorubicin, idarubicin, pirarubicin, valrubicin, and zorubicin); and anthracenediones (e.g., mitoxantrone, and pixantrone).

Chemotherapeutic agents that are DNA crosslinkers (or DNA damaging agents) include, but are not limited to, alkylating agents (e.g., cyclophosphamide, mechlorethamine, ifosfamide (branded/marketed as IFEX®), trofosfamide, chlorambucil, melphalan, prednimustine, bendamustine, uramustine, estramustine, carmustine (branded/marketed as BiCNU®), lomustine, semustine, fotemustine, nimustine, ranimustine, streptozocin, busulfan, mannosulfan, treosulfan, carboquone, N,N'N'-triethylenethiophosphoramide, triaziquone, triethylenemelamine); alkylating-like agents (e.g., carboplatin (branded/marketed as PARAPLATIN®), cisplatin, oxaliplatin, nedaplatin, triplatin tetranitrate, satraplatin, picoplatin); nonclassical DNA crosslinkers (e.g., procarbazine, dacarbazine, temozolomide (branded/marketed as TEMODAR®), altretamine, mitobronitol); and intercalating agents (e.g., actinomycin, bleomycin, mitomycin, and plicamycin).

Non-limiting examples of other therapies that can be administered to a subject in combination with the peptidomimetic macrocycles include: (1) a statin such as lovostatin (e.g., branded/marketed as MEVACOR®); (2) an mTOR inhibitor such as sirolimus which is also known as Rapamycin (e.g., branded/marketed as RAPAMUNE®), temsirolimus (e.g., branded/marketed as TORISEL®), evorolimus (e.g., branded/marketed as AFINITOR®), and deforolimus; (3) a farnesyltransferase inhibitor agent such as tipifarnib; (4) an antifibrotic agent such as pirfenidone; (5) a pegylated interferon such as PEG-interferon alfa-2b; (6) a CNS stimulant such as methylphenidate (branded/marketed as RITALIN®); (7) a HER-2 antagonist such as anti-HER-2 antibody (e.g., trastuzumab) and kinase inhibitor (e.g., lapatinib); (8) an IGF-1 antagonist such as an anti-IGF-1 antibody (e.g., AVE1642 and IMC-A11) or an IGF-1 kinase inhibitor; (9) EGFR/HER-1 antagonist such as an anti-EGFR antibody (e.g., cetuximab, panitumamab) or EGFR kinase inhibitor (e.g., erlotinib; gefitinib); (10) SRC antagonist such as bosutinib; (11) cyclin dependent kinase (CDK) inhibitor such as seliciclib; (12) Janus kinase 2 inhibitor such as lestaurtinib; (13) proteasome inhibitor such as bortezomib; (14) phosphodiesterase inhibitor such as anagrelide; (15) inosine monophosphate dehydrogenase inhibitor such as tiazofurine; (16) lipoxygenase inhibitor such as masoprocol; (17) endothelin antagonist; (18) retinoid receptor antagonist such as tretinoin or alitretinoin; (19) immune modulator such as lenalidomide, pomalidomide, or thalidomide; (20) kinase (e.g., tyrosine kinase) inhibitor such as imatinib, dasatinib, erlotinib, nilotinib, gefitinib, sorafenib, sunitinib, lapatinib, or TG100801; (21) non-steroidal anti-inflammatory agent such as celecoxib (branded/marketed as CELEBREX®); (22) human granulocyte colony-stimulating factor (G-CSF) such as filgrastim (branded/marketed as NEUPOGEN®); (23) folinic acid or leucovorin calcium; (24) integrin antagonist such as an integrin α5β1-antagonist (e.g., JSM6427); (25) nuclear factor kappa beta (NF-κβ) antagonist such as OT-551, which is also an anti-oxidant. (26) hedgehog inhibitor such as CUR61414, cyclopamine, GDC-0449, and anti-hedgehog antibody; (27) histone deacetylase (HDAC) inhibitor such as SAHA (also known as vorinostat (branded/marketed as ZOLINZA)), PCI-24781, SB939, CHR-3996, CRA-024781, ITF2357, JNJ-26481585, or PCI-24781; (28) retinoid such as isotretinoin (e.g., branded/marketed as ACCUTANE®); (29) hepatocyte growth factor/scatter factor (HGF/SF) antagonist such as HGF/SF monoclonal antibody (e.g., AMG 102); (30) synthetic chemical such as antineoplaston; (31) anti-diabetic such as rosaiglitazone (e.g., branded/marketed as AVANDIA®); (32) antimalarial and amebicidal drug such as chloroquine (e.g., branded/marketed as ARALEN®); (33) synthetic bradykinin such as RMP-7; (34) platelet-derived growth factor receptor inhibitor such as SU-101; (35) receptor tyrosine kinase inhibitorsof Flk-1/KDR/VEGFR2, FGFR1 and PDGFR beta such as SU5416 and SU6668; (36) anti-inflammatory agent such as sulfasalazine (e.g., branded/marketed as AZULFIDINE®); and (37) TGF-beta antisense therapy.

In some embodiments the peptidomimetic macrocycles disclosed herein can inhibit one or more transporter enzymes (e.g., OATPIBI, OATP1B3, BSEP) at concentrations that can be clinically relevant. Therefore the peptidomimetic macrocycles disclosed herein can interact with medications that are predominantly cleared by hepatobiliary transporters. In particular, methotrexate and statins (e.g., atorvastatin, fluvastatin lovastatin, pitavastatin pravastatin, rosuvastatin and simvastatin) can not be dosed within 48 h, 36 h, 24 h, or 12 h ((for example within 24 h) of the administration of the peptidomimetic macrocycles disclosed herein. Examples of medications that can be affected by co-administration with peptidomimetic macrocycles disclosed herein are listed below. In various embodiments one or more of the medications selected from Table 1 is not dosed within 48 h, 36 h, 24 h, or 12 h (for example within 24 h) of the administration of the peptidomimetic macrocycles disclosed herein.

TABLE 2

Exemple medications that can be affected by co-administration with peptidomimetic macrocycles disclosed herein.

| Medication | Therapeutic Area |
| --- | --- |
| Irinotecan | Oncology |
| Bosentan | Pulmonary artery hypertension |
| Caspofungin | Antifungal |
| Methotrexate | Oncology & rheumatology |
| Repaglinide | Diabetes mellitus |
| Atorvastatin | Hypercholesterolemia |
| Cerivastatin | Hypercholesterolemia |
| Fluvastatin | Hypercholesterolemia |
| Lovastatin | Hypercholesterolemia |
| Pitavastatin | Hypercholesterolemia |
| Pravastatin | Hypercholesterolemia |
| Rosuvastatin | Hypercholesterolemia |
| Simvastatin | Hypercholesterolemia |

Biological Samples

As used in the present application, "biological sample" means any fluid or other material derived from the body of a normal or diseased subject, such as blood, serum, plasma, lymph, urine, saliva, tears, cerebrospinal fluid, milk, amniotic fluid, bile, ascites fluid, pus, and the like. Also included within the meaning of the term "biological sample" is an organ or tissue extract and culture fluid in which any cells or tissue preparation from a subject has been incubated. The biological samples can be any samples from which genetic material can be obtained. Biological samples can also include solid or liquid cancer cell samples or specimens. The cancer cell sample can be a cancer cell tissue sample. In some embodiments, the cancer cell tissue sample can obtained from surgically excised tissue. Exemplary sources of biological samples include fine needle aspiration, core needle biopsy, vacuum assisted biopsy, incisional biopsy, excisional biopsy, punch biopsy, shave biopsy or skin biopsy. In some cases, the biological samples comprise fine needle aspiration samples. In some embodiments, the biological samples comprise tissue samples, including, for example, excisional biopsy, incisional biopsy, or other biopsy. The biological samples can comprise a mixture of two or more sources; for example, fine needle aspirates and tissue samples. Tissue samples and cellular samples can also be obtained without invasive surgery, for example by punctuating the chest wall or the abdominal wall or from masses of breast, thyroid or other sites with a fine needle and withdrawing cellular material (fine needle aspiration biopsy). In some embodiments, a biological sample is a bone marrow aspirate sample. A biological sample can be obtained by biopsy methods provided herein, swabbing, scraping, phlebotomy, or any other suitable method.

Methods of Detecting Wild Type p53 and/or p53 Mutations

In some embodiments, a subject lacking p53-deactivating mutations is a candidate for cancer treatment with a compound of the invention. Cancer cells from patient groups should be assayed in order to determine p53-deactivating mutations and/or expression of wild type p53 prior to treatment with a compound of the invention.

The activity of the p53 pathway can be determined by the mutational status of genes involved in the p53 pathways, including, for example, AKT1, AKT2, AKT3, ALK, BRAF, CDK4, CDKN2A, DDR2, EGFR, ERBB2 (HER2), FGFR1, FGFR3, GNA11, GNQ, GNAS, KDR, KIT, KRAS, MAP2K1 (MEK1), MET, HRAS, NOTCH1, NRAS, NTRK2, PIK3CA, NF1, PTEN, RAC1, RB1, NTRK3, STK11, PIK3R1, TSC1, TSC2, RET, TP53, and VHL. Genes that modulate the activity of p53 can also be assessed, including, for example, kinases: ABL1, JAK1, JAAK2, JAK3; receptor tyrosine kinases: FLT3 and KIT; receptors: CSF3R, IL7R, MPL, and NOTCH1; transcription factors: BCOR, CEBPA, CREBBP, ETV6, GATA1, GATA2, MLL, KZF1, PAX5, RUNX1, STAT3, WT1, and TP53; epigenetic factors: ASXL1, DNMT3A, EZH2, KDM6A (UTX), SUZ12, TET2, PTPN11, SF3B1, SRSF2, U2AF35, ZRSR2; RAS proteins: HRAS, KRAS, and NRAS; adaptors CBL and CBL-B; FBXW7, IDH1, IDH2, and NPM1.

Cancer cell samples can be obtained, for example, from solid or liquid tumors via primary or metastatic tumor resection (e.g. pneumonectomy, lobetomy, wedge resection, and craniotomy) primary or metastatic disease biopsy (e.g. transbronchial or needle core), pleural or ascites fluid (e.g. FFPE cell pellet), bone marrow aspirate, bone marrow clot, and bone marrow biopsy, or macro-dissection of tumor rich areas (solid tumors).

To detect the p53 wild type gene and/or lack of p53 deactivation mutation in a tissue, cancerous tissue can be isolated from surrounding normal tissues. For example, the tissue can be isolated from paraffin or cryostat sections. Cancer cells can also be separated from normal cells by flow cytometry. If the cancer cells tissue is highly contaminated with normal cells, detection of mutations can be more difficult.

Various methods and assays for analyzing wild type p53 and/or p53 mutations are suitable for use in the invention. Non-limiting examples of assays include polymerase chain reaction (PCR), restriction fragment length polymorphism (RFLP), microarray, Southern Blot, Northern Blot, Western Blot, Eastern Blot, H&E staining, microscopic assessment of tumors, next-generation DNA sequencing (NGS) (e.g. extraction, purification, quantification, and amplification of DNA, library preparation) immunohistochemistry, and fluorescent in situ hybridization (FISH).

A microarray allows a researcher to investigate multiple DNA sequences attached to a surface, for example, a DNA chip made of glass or silicon, or a polymeric bead or resin. The DNA sequences are hybridized with fluorescent or luminescent probes. The microarray can indicate the presence of oligonucleotide sequences in a sample based on hybridization of sample sequences to the probes, followed by washing and subsequent detection of the probes. Quantification of the fluorescent or luminescent signal indicates the presence of known oligonucleotide sequences in the sample.

PCR allows amplification of DNA oligomers rapidly, and can be used to identify an oligonucleotide sequence in a sample. PCR experiments involve contacting an oligonucleotide sample with a PCR mixture containing primers complementary to a target sequence, one or more DNA polymerase enzymes, deoxnucleotide triphosphate (dNTP) building blocks, including dATP, dGTP, dTTP, and dCTP, and suitable buffers, salts, and additives. If a sample contains an oligonucleotide sequence complementary to a pair of primers, the experiment amplifies the sample sequence, which can be collected and identified.

In some embodiments, an assay comprises amplifying a biomolecule from the cancer sample. The biomolecule can be a nucleic acid molecule, such as DNA or RNA. In some embodiments, the assay comprises circularization of a nucleic acid molecule, followed by digestion of the circularized nucleic acid molecule.

In some embodiments, the assay comprises contacting an organism, or a biochemical sample collected from an organism, such as a nucleic acid sample, with a library of oligonucleotides, such as PCR primers. The library can contain any number of oligonucleotide molecules. The oligonucleotide molecules can bind individual DNA or RNA motifs, or any combination of motifs described herein. The motifs can be any distance apart, and the distance can be known or unknown. In some embodiments, two or more oligonucleotides in the same library bind motifs a known distance apart in a parent nucleic acid sequence. Binding of the primers to the parent sequence can take place based on the complementarity of the primers to the parent sequence. Binding can take place, for example, under annealing, or under stringent conditions.

In some embodiments, the results of an assay are used to design a new oligonucleotide sequence for future use. In some embodiments, the results of an assay are used to design a new oligonucleotide library for future use. In some embodiments, the results of an assay are used to revise, refine, or update an existing oligonucleotide library for future use. For example, an assay can reveal that a previously-undocumented nucleic acid sequence is associated with the presence of a target material. This information can be used to design or redesign nucleic acid molecules and libraries.

In some embodiments, one or more nucleic acid molecules in a library comprise a barcode tag. In some embodiments, one or more of the nucleic acid molecules in a library comprise type I or type II restriction sites suitable for circularization and cutting an amplified sample nucleic acid sequence. Such primers can be used to circularize a PCR product and cut the PCR product to provide a product nucleic acid sequence with a sequence that is organized differently from the nucleic acid sequence native to the sample organism.

After a PCR experiment, the presence of an amplified sequence can be verified. Non-limiting examples of methods for finding an amplified sequence include DNA sequencing, whole transcriptome shotgun sequencing (WTSS, or RNA-seq), mass spectrometry (MS), microarray, pyrosequencing, column purification analysis, polyacrylamide gel electrophoresis, and index tag sequencing of a PCR product generated from an index-tagged primer.

In some embodiments, more than one nucleic acid sequence in the sample organism is amplified. Non-limiting examples of methods of separating different nucleic acid sequences in a PCR product mixture include column purification, high performance liquid chromatography (HPLC), HPLC/MS, polyacrylamide gel electrophoresis, size exclusion chromatography.

The amplified nucleic acid molecules can be identified by sequencing. Nucleic acid sequencing can be done on automated instrumentation. Sequencing experiments can be done in parallel to analyze tens, hundreds, or thousands of sequences simultaneously. Non-limiting examples of sequencing techniques follow.

In pyrosequencing, DNA is amplified within a water droplet containing a single DNA template bound to a primer-coated bead in an oil solution. Nucleotides are added to a growing sequence, and the addition of each base is evidenced by visual light.

Ion semiconductor sequencing detects the addition of a nucleic acid residue as an electrical signal associated with a hydrogen ion liberated during synthesis. A reaction well containing a template is flooded with the four types of nucleotide building blocks, one at a time. The timing of the electrical signal identifies which building block was added, and identifies the corresponding residue in the template.

DNA nanoball uses rolling circle replication to amplify DNA into nanoballs. Unchained sequencing by ligation of the nanoballs reveals the DNA sequence.

In a reversible dyes approach, nucleic acid molecules are annealed to primers on a slide and amplified. Four types of fluorescent dye residues, each complementary to a native nucleobase, are added, the residue complementary to the next base in the nucleic acid sequence is added, and unincorporated dyes are rinsed from the slide. Four types of reversible terminator bases (RT-bases) are added, and non-incorporated nucleotides are washed away. Fluorescence indicates the addition of a dye residue, thus identifying the complementary base in the template sequence. The dye residue is chemically removed, and the cycle repeats.

Detection of point mutations can be accomplished by molecular cloning of the p53 allele(s) present in the cancer cell tissue and sequencing that allele(s). Alternatively, the polymerase chain reaction can be used to amplify p53 gene sequences directly from a genomic DNA preparation from the cancer cell tissue. The DNA sequence of the amplified sequences can then be determined. See e.g., Saiki et al., *Science*, Vol. 239, p. 487, 1988; U.S. Pat. No. 4,683,202; and 4,683,195. Specific deletions of p53 genes can also be detected. For example, restriction fragment length polymorphism (RFLP) probes for the p53 gene or surrounding marker genes can be used to score loss of a p53 allele.

Loss of wild type p53 genes can also be detected on the basis of the loss of a wild type expression product of the p53 gene. Such expression products include both the mRNA as well as the p53 protein product itself. Point mutations can be detected by sequencing the mRNA directly or via molecular cloning of cDNA made from the mRNA. The sequence of the cloned cDNA can be determined using DNA sequencing techniques. The cDNA can also be sequenced via the polymerase chain reaction (PCR).

Alternatively, mismatch detection can be used to detect point mutations in the p53 gene or the mRNA product. The method can involve the use of a labeled riboprobe that is complementary to the human wild type p53 gene. The riboprobe and either mRNA or DNA isolated from the cancer cell tissue are annealed (hybridized) together and subsequently digested with the enzyme RNase A which is able to detect some mismatches in a duplex RNA structure. If a mismatch is detected by RNase A, the enzyme cleaves at the site of the mismatch. Thus, when the annealed RNA preparation is separated on an electrophoretic gel matrix, if a mismatch has been detected and cleaved by RNase A, an RNA product is seen that is smaller than the full-length duplex RNA for the riboprobe and the p53 mRNA or DNA. The riboprobe need not be the full length of the p53 mRNA or gene but can be a segment of either. If the riboprobe comprises only a segment of the p53 mRNA or gene it will be desirable to use a number of these probes to screen the whole mRNA sequence for mismatches.

In similar fashion, DNA probes can be used to detect mismatches, through enzymatic or chemical cleavage. See, e.g., Cotton et al., *Proc. Natl. Acad. Sci. USA*, vol. 85, 4397, 1988; and Shenk et al., *Proc. Natl. Acad. Sci. USA*, vol. 72, p. 989, 1975. Alternatively, mismatches can be detected by shifts in the electrophoretic mobility of mismatched duplexes relative to matched duplexes. See, e.g., Cariello, Human Genetics, vol. 42, p. 726, 1988. With either riboprobes or DNA probes, the cellular mRNA or DNA which might contain a mutation can be amplified using PCR (see below) before hybridization.

DNA sequences of the p53 gene from the cancer cell tissue which have been amplified by use of polymerase chain reaction can also be screened using allele-specific probes. These probes are nucleic acid oligomers, each of which contains a region of the p53 gene sequence harboring a known mutation. For example, one oligomer can be about 30 nucleotides in length, corresponding to a portion of the p53 gene sequence. At the position coding for the 175th codon of p53 gene the oligomer encodes an alanine, rather than the wild type codon valine. By use of a battery of such allele-specific probes, the PCR amplification products can be screened to identify the presence of a previously identified mutation in the p53 gene. Hybridization of allele-specific probes with amplified p53 sequences can be performed, for example, on a nylon filter. Hybridization to a particular probe indicates the presence of the same mutation in the cancer cell tissue as in the allele-specific probe.

The identification of p53 gene structural changes in cancer cells can be facilitated through the application of a diverse series of high resolution, high throughput microarray platforms. Essentially two types of array include those that carry PCR products from cloned nucleic acids (e.g. cDNA, BACs, cosmids) and those that use oligonucleotides. The methods can provide a way to survey genome wide DNA copy number abnormalities and expression levels to allow correlations between losses, gains and amplifications in cancer cells with genes that are over- and under-expressed in the same samples. The gene expression arrays that provide estimates of mRNA levels in cancer cells have given rise to exon-specific arrays that can identify both gene expression levels, alternative splicing events and mRNA processing alterations.

Oligonucleotide arrays can be used to interrogate single nucleotide polymorphisms (SNPs) throughout the genome for linkage and association studies and these have been adapted to quantify copy number abnormalities and loss of heterozygosity events. DNA sequencing arrays can allow resequencing of chromosome regions, exomes, and whole genomes.

SNP-based arrays or other gene arrays or chips can determine the presence of wild type p53 allele and the structure of mutations. A single nucleotide polymorphism (SNP), a variation at a single site in DNA, is the most frequent type of variation in the genome. For example, there are an estimated 5-10 million SNPs in the human genome. SNPs can be synonymous or nonsynonymous substitutions. Synonymous SNP substitutions do not result in a change of amino acid in the protein due to the degeneracy of the genetic code, but can affect function in other ways. For example, a seemingly silent mutation in gene that codes for a membrane transport protein can slow down translation, allowing the peptide chain to misfold, and produce a less functional mutant membrane transport protein. Nonsynonymous SNP substitutions can be missense substitutions or nonsense substitutions. Missense substitutions occur when a single base change results in change in amino acid sequence of the protein and malfunction thereof leads to disease. Nonsense substitutions occur when a point mutation results in a premature stop codon, or a nonsense codon in the transcribed mRNA, which results in a truncated and usually, nonfunctional, protein product. As SNPs are highly conserved throughout evolution and within a population, the map of SNPs serves as an excellent genotypic marker for research. SNP array is a useful tool to study the whole genome.

In addition, SNP array can be used for studying the Loss Of Heterozygosity (LOH). LOH is a form of allelic imbalance that can result from the complete loss of an allele or from an increase in copy number of one allele relative to the other. While other chip-based methods (e.g., comparative genomic hybridization can detect only genomic gains or deletions), SNP array has the additional advantage of detecting copy number neutral LOH due to uniparental disomy (UPD). In UPD, one allele or whole chromosome from one parent are missing leading to reduplication of the other parental allele (uni-parental=from one parent, disomy=duplicated). In a disease setting this occurrence can be pathologic when the wild type allele (e.g., from the mother) is missing and instead two copies of the heterozygous allele (e.g., from the father) are present. This usage of SNP array has a huge potential in cancer diagnostics as LOH is a prominent characteristic of most human cancers. SNP array technology have shown that cancers (e.g. gastric cancer, liver cancer, etc.) and hematologic malignancies (ALL, MDS, CML etc) have a high rate of LOH due to genomic deletions or UPD and genomic gains. In the present disclosure, using high density SNP array to detect LOH allows identification of pattern of allelic imbalance to determine the presence of wild type p53 allele (Lips et al., 2005; Lai et al., 2007).

Examples of p53 gene sequence and single nucleotide polymorphism arrays include p53 Gene Chip (Affymetrix, Santa Clara, Calif.), Roche p53 Ampli-Chip (Roche Molecular Systems, Pleasanton, Calif.), GeneChip Mapping arrays (Affymetrix, Santa Clara, Calif.), SNP Array 6.0 (Affymetrix, Santa Clara, Calif.), BeadArrays (Illumina, San Diego, Calif.), etc.

Mutations of wild type p53 genes can also be detected on the basis of the mutation of a wild type expression product of the p53 gene. Such expression products include both the mRNA as well as the p53 protein product itself. Point mutations can be detected by sequencing the mRNA directly or via molecular cloning of cDNA made from the mRNA. The sequence of the cloned cDNA can be determined using DNA sequencing techniques. The cDNA can also be sequenced via the polymerase chain reaction (PCR). A panel of monoclonal antibodies could be used in which each of the epitopes involved in p53 functions are represented by a monoclonal antibody. Loss or perturbation of binding of a monoclonal antibody in the panel can indicate mutational alteration of the p53 protein and thus of the p53 gene itself. Mutant p53 genes or gene products can also be detected in body samples, including, for example, serum, stool, urine, and sputum. The same techniques discussed above for detection of mutant p53 genes or gene products in tissues can be applied to other body samples.

Loss of wild type p53 genes can also be detected by screening for loss of wild type p53 protein function. Although all of the functions which the p53 protein undoubtedly possesses have yet to be elucidated, at least two specific functions are known. Protein p53 binds to the SV40 large T antigen as well as to the adenovirus E1B antigen. Loss of the ability of the p53 protein to bind to either or both of these antigens indicates a mutational alteration in the protein which reflects a mutational alteration of the gene itself. Alternatively, a panel of monoclonal antibodies could be used in which each of the epitopes involved in p53 functions are represented by a monoclonal antibody. Loss or perturbation of binding of a monoclonal antibody in the panel would indicate mutational alteration of the p53 protein and thus of the p53 gene itself. Any method for detecting an altered p53 protein can be used to detect loss of wild type p53 genes.

EXAMPLES

Example 1: Peptidomimetic Macrocycles

Peptidomimetic macrocycles were synthesized, purified and analyzed as previously described and as described below (Schafmeister et al., J. Am. Chem. Soc. 122:5891-5892 (2000); Schafmeister & Verdine, J. Am. Chem. Soc. 122:5891 (2005); Walensky et al., Science 305:1466-1470 (2004); and U.S. Pat. No. 7,192,713). Peptidomimetic macrocycles were designed by replacing two or more naturally occurring amino acids with the corresponding synthetic amino acids. Substitutions were made at i and i+4, and i and i+7 positions. Peptide synthesis was performed either manually or on an automated peptide synthesizer (Applied Biosystems, model 433A), using solid phase conditions, rink amide AM resin (Novabiochem), and Fmoc main-chain protecting group chemistry. For the coupling of natural Fmoc-protected amino acids (Novabiochem), 10 equivalents of amino acid and a 1:1:2 molar ratio of coupling reagents HBTU/HOBt (Novabiochem)/DIEA were employed. Non-natural amino acids (4 equiv) were coupled with a 1:1:2 molar ratio of HATU (Applied Biosystems)/HOBt/DIEA. The N-termini of the synthetic peptides were acetylated, while the C-termini were amidated.

Purification of cross-linked compounds was achieved by high performance liquid chromatography (HPLC) (Varian ProStar) on a reverse phase C18 column (Varian) to yield the pure compounds. Chemical composition of the pure products was confirmed by LC/MS mass spectrometry (Micromass LCT interfaced with Agilent 1100 HPLC system) and amino acid analysis (Applied Biosystems, model 420A).

The following protocol was used in the synthesis of dialkyne-crosslinked peptidomimetic macrocycles, including SP662, SP663 and SP664. Fully protected resin-bound peptides were synthesized on a PEG-PS resin (loading 0.45 mmol/g) on a 0.2 mmol scale. Deprotection of the temporary Fmoc group was achieved by 3×10 min treatments of the resin bound peptide with 20% (v/v) piperidine in DMF. After washing with NMP (3×), dichloromethane (3×) and NMP (3×), coupling of each successive amino acid was achieved with 1×60 min incubation with the appropriate preactivated Fmoc-amino acid derivative. All protected amino acids (0.4 mmol) were dissolved in NMP and activated with HCTU (0.4 mmol) and DIEA (0.8 mmol) prior to transfer of the coupling solution to the deprotected resin-bound peptide. After coupling was completed, the resin was washed in preparation for the next deprotection/coupling cycle. Acetylation of the amino terminus was carried out in the presence of acetic anhydride/DIEA in NMP. The LC-MS analysis of a cleaved and deprotected sample obtained from an aliquot of the fully assembled resin-bound peptide was accomplished in order to verifying the completion of each coupling. In a typical example, tetrahydrofuran (4 ml) and triethylamine (2 ml) were added to the peptide resin (0.2 mmol) in a 40 ml glass vial and shaken for 10 minutes. $Pd(PPh_3)_2Cl_2$ (0.014 g, 0.02 mmol) and copper iodide (0.008 g, 0.04 mmol) were then added and the resulting reaction mixture was mechanically shaken 16 hours while open to atmosphere. The diyne-cyclized resin-bound peptides were deprotected and cleaved from the solid support by treatment with $TFA/H_2O/TIS$ (95/5/5 v/v) for 2.5 h at room temperature. After filtration of the resin the TFA solution was precipitated in cold diethyl ether and centrifuged to yield the desired product as a solid. The crude product was purified by preparative HPLC.

The following protocol was used in the synthesis of single alkyne-crosslinked peptidomimetic macrocycles, including SP665. Fully protected resin-bound peptides were synthesized on a Rink amide MBHA resin (loading 0.62 mmol/g) on a 0.1 mmol scale. Deprotection of the temporary Fmoc group was achieved by 2×20 min treatments of the resin bound peptide with 25% (v/v) piperidine in NMP. After extensive flow washing with NMP and dichloromethane, coupling of each successive amino acid was achieved with 1×60 min incubation with the appropriate preactivated Fmoc-amino acid derivative. All protected amino acids (1 mmol) were dissolved in NMP and activated with HCTU (1 mmol) and DIEA (1 mmol) prior to transfer of the coupling solution to the deprotected resin-bound peptide. After coupling was completed, the resin was extensively flow washed in preparation for the next deprotection/coupling cycle. Acetylation of the amino terminus was carried out in the presence of acetic anhydride/DIEA in NMP/NMM. The LC-MS analysis of a cleaved and deprotected sample obtained from an aliquot of the fully assembled resin-bound peptide was accomplished in order to verifying the completion of each coupling. In a typical example, the peptide resin (0.1 mmol) was washed with DCM. Resin was loaded into a microwave vial. The vessel was evacuated and purged with nitrogen. Molybdenumhexacarbonyl (0.01 eq, Sigma Aldrich 199959) was added. Anhydrous chlorobenzene was added to the reaction vessel. Then 2-fluorophenol (1 eq, Sigma Aldrich F12804) was added. The reaction was then loaded into the microwave and held at 130° C. for 10 minutes. Reaction can need to be pushed a subsequent time for completion. The alkyne metathesized resin-bound peptides were deprotected and cleaved from the solid support by treatment with $TFA/H_2O/TIS$ (94/3/3 v/v) for 3 h at room temperature. After filtration of the resin the TFA solution was precipitated in cold diethyl ether and centrifuged to yield the desired product as a solid. The crude product was purified by preparative HPLC.

Table 3 shows a list of peptidomimetic macrocycles prepared.

TABLE 3

| SP | Sequence | SEQ ID NO: | Isomer | Exact Mass | Found Mass | Calc (M + 1)/1 | Calc (M + 2)/2 | Calc (M + 3)/3 |
|---|---|---|---|---|---|---|---|---|
| SP1 | Ac-F$r8AYWEAc3cL$AAA-NH2 | 10 | | 1456.78 | 729.44 | 1457.79 | 729.4 | 486.6 |
| SP2 | Ac-F$r8AYWEAc3cL$AAibA-NH2 | 11 | | 1470.79 | 736.4 | 1471.8 | 736.4 | 491.27 |
| SP3 | Ac-LTF$r8AYWAQL$SANle-NH2 | 12 | | 1715.97 | 859.02 | 1716.98 | 858.99 | 573 |
| SP4 | Ac-LTF$r8AYWAQL$SAL-NH2 | 13 | | 1715.97 | 859.02 | 1716.98 | 858.99 | 573 |
| SP5 | Ac-LTF$r8AYWAQL$SAM-NH2 | 14 | | 1733.92 | 868.48 | 1734.93 | 867.97 | 578.98 |
| SP6 | Ac-LTF$r8AYWAQL$SAhL-NH2 | 15 | | 1729.98 | 865.98 | 1730.99 | 866 | 577.67 |
| SP7 | Ac-LTF$r8AYWAQL$SAF-NH2 | 16 | | 1749.95 | 876.36 | 1750.96 | 875.98 | 584.32 |
| SP8 | Ac-LTF$r8AYWAQL$SAI-NH2 | 17 | | 1715.97 | 859.02 | 1716.98 | 858.99 | 573 |
| SP9 | Ac-LTF$r8AYWAQL$SAChg-NH2 | 18 | | 1741.98 | 871.98 | 1742.99 | 872 | 581.67 |
| SP10 | Ac-LTF$r8AYWAQL$SAAib-NH2 | 19 | | 1687.93 | 845.36 | 1688.94 | 844.97 | 563.65 |
| SP11 | Ac-LTF$r8AYWAQL$SAA-NH2 | 20 | | 1673.92 | 838.01 | 1674.93 | 837.97 | 558.98 |
| SP12 | Ac-LTF$r8AYWA$L$S$Nle-NH2 | 21 | | 1767.04 | 884.77 | 1768.05 | 884.53 | 590.02 |
| SP13 | Ac-LTF$r8AYWA$L$S$A-NH2 | 22 | | 1724.99 | 864.23 | 1726 | 863.5 | 576 |
| SP14 | Ac-F$r8AYWEAc3cL$AANle-NH2 | 23 | | 1498.82 | 750.46 | 1499.83 | 750.42 | 500.61 |
| SP15 | Ac-F$r8AYWEAc3cL$AAL-NH2 | 24 | | 1498.82 | 750.46 | 1499.83 | 750.42 | 500.61 |
| SP16 | Ac-F$r8AYWEAc3cL$AAM-NH2 | 25 | | 1516.78 | 759.41 | 1517.79 | 759.4 | 506.6 |
| SP17 | Ac-F$r8AYWEAc3cL$AAhL-NH2 | 26 | | 1512.84 | 757.49 | 1513.85 | 757.43 | 505.29 |
| SP18 | Ac-F$r8AYWEAc3cL$AAF-NH2 | 27 | | 1532.81 | 767.48 | 1533.82 | 767.41 | 511.94 |
| SP19 | Ac-F$r8AYWEAc3cL$AAI-NH2 | 28 | | 1498.82 | 750.39 | 1499.83 | 750.42 | 500.61 |
| SP20 | Ac-F$r8AYWEAc3cL$AAChg-NH2 | 29 | | 1524.84 | 763.48 | 1525.85 | 763.43 | 509.29 |
| SP21 | Ac-F$r8AYWEAc3cL$AACha-NH2 | 30 | | 1538.85 | 770.44 | 1539.86 | 770.43 | 513.96 |
| SP22 | Ac-F$r8AYWEAc3cL$AAAib-NH2 | 31 | | 1470.79 | 736.84 | 1471.8 | 736.4 | 491.27 |
| SP23 | Ac-LTF$r8AYWAQL$AAAibV-NH2 | 32 | | 1771.01 | 885.81 | 1772.02 | 886.51 | 591.34 |
| SP24 | Ac-LTF$r8AYWAQL$AAAibV-NH2 | 33 | iso2 | 1771.01 | 886.26 | 1772.02 | 886.51 | 591.34 |
| SP25 | Ac-LTF$r8AYWAQL$SAibAA-NH2 | 34 | | 1758.97 | 879.89 | 1759.98 | 880.49 | 587.33 |
| SP26 | Ac-LTF$r8AYWAQL$SAibAA-NH2 | 35 | iso2 | 1758.97 | 880.34 | 1759.98 | 880.49 | 587.33 |
| SP27 | Ac-HLTF$r8HHWHQL$AANleNle-NH2 | 36 | | 2056.15 | 1028.86 | 2057.16 | 1029.08 | 686.39 |
| SP28 | Ac-DLTF$r8HHWHQL$RRLV-NH2 | 37 | | 2190.23 | 731.15 | 2191.24 | 1096.12 | 731.08 |
| SP29 | Ac-HHTF$r8HHWHQL$AAML-NH2 | 38 | | 2098.08 | 700.43 | 2099.09 | 1050.05 | 700.37 |
| SP30 | Ac-F$r8HHWHQL$RRDCha-NH2 | 39 | | 1917.06 | 959.96 | 1918.07 | 959.54 | 640.03 |
| SP31 | Ac-F$r8HHWHQL$HRFV-NH2 | 40 | | 1876.02 | 938.65 | 1877.03 | 939.02 | 626.35 |
| SP32 | Ac-HLTF$r8HHWHQL$AAhLA-NH2 | 41 | | 2028.12 | 677.2 | 2029.13 | 1015.07 | 677.05 |
| SP33 | Ac-DLTF$r8HHWHQL$RRChgl-NH2 | 42 | | 2230.26 | 1115.89 | 2231.27 | 1116.14 | 744.43 |
| SP34 | Ac-DLTF$r8HHWHQL$RRChgl-NH2 | 43 | iso2 | 2230.26 | 1115.96 | 2231.27 | 1116.14 | 744.43 |
| SP35 | Ac-HHTF$r8HHWHQL$AAChav-NH2 | 44 | | 2106.14 | 1053.95 | 2107.15 | 1054.08 | 703.05 |

TABLE 3-continued

| SP | Sequence | SEQ ID NO: | Isomer | Exact Mass | Found Mass | Calc (M + 1)/1 | Calc (M + 2)/2 | Calc (M + 3)/3 |
|---|---|---|---|---|---|---|---|---|
| SP36 | Ac-F$r8HHWHQL$RRDa-NH2 | 45 | | 1834.99 | 918.3 | 1836 | 918.5 | 612.67 |
| SP37 | Ac-F$r8HHWHQL$HRAibG-NH2 | 46 | | 1771.95 | 886.77 | 1772.96 | 886.98 | 591.66 |
| SP38 | Ac-F$r8AYWAQL$HHNleL-NH2 | 47 | | 1730.97 | 866.57 | 1731.98 | 866.49 | 578 |
| SP39 | Ac-F$r8AYWSAL$HQANle-NH2 | 48 | | 1638.89 | 820.54 | 1639.9 | 820.45 | 547.3 |
| SP40 | Ac-F$r8AYWVQL$QHChgl-NH2 | 49 | | 1776.01 | 889.44 | 1777.02 | 889.01 | 593.01 |
| SP41 | Ac-F$r8AYWTAL$QQNlev-NH2 | 50 | | 1671.94 | 836.97 | 1672.95 | 836.98 | 558.32 |
| SP42 | Ac-F$r8AYWYQL$HAibAa-NH2 | 51 | | 1686.89 | 844.52 | 1687.9 | 844.45 | 563.3 |
| SP43 | Ac-LTF$r8AYWAQL$HHLa-NH2 | 52 | | 1903.05 | 952.27 | 1904.06 | 952.53 | 635.36 |
| SP44 | Ac-LTF$r8AYWAQL$HHLa-NH2 | 53 | iso2 | 1903.05 | 952.27 | 1904.06 | 952.53 | 635.36 |
| SP45 | Ac-LTF$r8AYWAQL$HQNlev-NH2 | 54 | | 1922.08 | 962.48 | 1923.09 | 962.05 | 641.7 |
| SP46 | Ac-LTF$r8AYWAQL$HQNlev-NH2 | 55 | iso2 | 1922.08 | 962.4 | 1923.09 | 962.05 | 641.7 |
| SP47 | Ac-LTF$r8AYWAQL$QQMl-NH2 | 56 | | 1945.05 | 973.95 | 1946.06 | 973.53 | 649.36 |
| SP48 | Ac-LTF$r8AYWAQL$QQMl-NH2 | 57 | iso2 | 1945.05 | 973.88 | 1946.06 | 973.53 | 649.36 |
| SP49 | Ac-LTF$r8AYWAQL$HAibhLV-NH2 | 58 | | 1893.09 | 948.31 | 1894.1 | 947.55 | 632.04 |
| SP50 | Ac-LTF$r8AYWAQL$AHFA-NH2 | 59 | | 1871.01 | 937.4 | 1872.02 | 936.51 | 624.68 |
| SP51 | Ac-HLTF$r8HHWHQL$AANlel-NH2 | 60 | | 2056.15 | 1028.79 | 2057.16 | 1029.08 | 686.39 |
| SP52 | Ac-DLTF$r8HHWHQL$RRLa-NH2 | 61 | | 2162.2 | 721.82 | 2163.21 | 1082.11 | 721.74 |
| SP53 | Ac-HHTF$r8HHWHQL$AAMv-NH2 | 62 | | 2084.07 | 1042.92 | 2085.08 | 1043.04 | 695.7 |
| SP54 | Ac-F$r8HHWHQL$RRDA-NH2 | 63 | | 1834.99 | 612.74 | 1836 | 918.5 | 612.67 |
| SP55 | Ac-F$r8HHWHQL$HRFCha-NH2 | 64 | | 1930.06 | 966.47 | 1931.07 | 966.04 | 644.36 |
| SP56 | Ac-F$r8AYWEAL$AA-NHAm | 65 | | 1443.82 | 1445.71 | 1444.83 | 722.92 | 482.28 |
| SP57 | Ac-F$r8AYWEAL$AA-NHiAm | 66 | | 1443.82 | 723.13 | 1444.83 | 722.92 | 482.28 |
| SP58 | Ac-F$r8AYWEAL$AA-NHnPr3Ph | 67 | | 1491.82 | 747.3 | 1492.83 | 746.92 | 498.28 |
| SP59 | Ac-F$r8AYWEAL$AA-NHnBu33Me | 68 | | 1457.83 | 1458.94 | 1458.84 | 729.92 | 486.95 |
| SP60 | Ac-F$r8AYWEAL$AA-NHnPr | 69 | | 1415.79 | 709.28 | 1416.8 | 708.9 | 472.94 |
| SP61 | Ac-F$r8AYWEAL$AA-NHnEt2Ch | 70 | | 1483.85 | 1485.77 | 1484.86 | 742.93 | 495.62 |
| SP62 | Ac-F$r8AYWEAL$AA-NHnEt2Cp | 71 | | 1469.83 | 1470.78 | 1470.84 | 735.92 | 490.95 |
| SP63 | Ac-F$r8AYWEAL$AA-NHHex | 72 | | 1457.83 | 730.19 | 1458.84 | 729.92 | 486.95 |
| SP64 | Ac-LTF$r8AYWAQL$AAIA-NH2 | 73 | | 1771.01 | 885.81 | 1772.02 | 886.51 | 591.34 |
| SP65 | Ac-LTF$r8AYWAQL$AAIA-NH2 | 74 | iso2 | 1771.01 | 866.8 | 1772.02 | 886.51 | 591.34 |
| SP66 | Ac-LTF$r8AYWAAL$AAMA-NH2 | 75 | | 1731.94 | 867.08 | 1732.95 | 866.98 | 578.32 |
| SP67 | Ac-LTF$r8AYWAAL$AAMA-NH2 | 76 | iso2 | 1731.94 | 867.28 | 1732.95 | 866.98 | 578.32 |
| SP68 | Ac-LTF$r8AYWAQL$AANleA-NH2 | 77 | | 1771.01 | 867.1 | 1772.02 | 886.51 | 591.34 |
| SP69 | Ac-LTF$r8AYWAQL$AANleA-NH2 | 78 | iso2 | 1771.01 | 886.89 | 1772.02 | 886.51 | 591.34 |
| SP70 | Ac-LTF$r8AYWAQL$AAIa-NH2 | 79 | | 1771.01 | 886.8 | 1772.02 | 886.51 | 591.34 |
| SP71 | Ac-LTF$r8AYWAQL$AAIa-NH2 | 80 | iso2 | 1771.01 | 887.09 | 1772.02 | 886.51 | 591.34 |
| SP72 | Ac-LTF$r8AYWAAL$AAMa-NH2 | 81 | | 1731.94 | 867.17 | 1732.95 | 866.98 | 578.32 |
| SP73 | Ac-LTF$r8AYWAAL$AAMa-NH2 | 82 | iso2 | 1731.94 | 867.37 | 1732.95 | 866.98 | 578.32 |
| SP74 | Ac-LTF$r8AYWAQL$AANlea-NH2 | 83 | | 1771.01 | 887.08 | 1772.02 | 886.51 | 591.34 |
| SP75 | Ac-LTF$r8AYWAQL$AANlea-NH2 | 84 | iso2 | 1771.01 | 887.08 | 1772.02 | 886.51 | 591.34 |
| SP76 | Ac-LTF$r8AYWAAL$AAIv-NH2 | 85 | | 1742.02 | 872.37 | 1743.03 | 872.02 | 581.68 |
| SP77 | Ac-LTF$r8AYWAAL$AAIv-NH2 | 86 | iso2 | 1742.02 | 872.74 | 1743.03 | 872.02 | 581.68 |
| SP78 | Ac-LTF$r8AYWAQL$AAMv-NH2 | 87 | | 1817 | 910.02 | 1818.01 | 909.51 | 606.67 |
| SP79 | Ac-LTF$r8AYWAAL$AANlev-NH2 | 88 | | 1742.02 | 872.37 | 1743.03 | 872.02 | 581.68 |
| SP80 | Ac-LTF$r8AYWAAL$AANlev-NH2 | 89 | iso2 | 1742.02 | 872.28 | 1743.03 | 872.02 | 581.68 |
| SP81 | Ac-LTF$r8AYWAQL$AAIl-NH2 | 90 | | 1813.05 | 907.81 | 1814.06 | 907.53 | 605.36 |
| SP82 | Ac-LTF$r8AYWAQL$AAIl-NH2 | 91 | iso2 | 1813.05 | 907.81 | 1814.06 | 907.53 | 605.36 |
| SP83 | Ac-LTF$r8AYWAAL$AAMl-NH2 | 92 | | 1773.99 | 887.37 | 1775 | 888 | 592.34 |
| SP84 | Ac-LTF$r8AYWAQL$AANlel-NH2 | 93 | | 1813.05 | 907.61 | 1814.06 | 907.53 | 605.36 |
| SP85 | Ac-LTF$r8AYWAQL$AANlel-NH2 | 94 | iso2 | 1813.05 | 907.71 | 1814.06 | 907.53 | 605.36 |
| SP86 | Ac-F$r8AYWEAL$AAMA-NH2 | 95 | | 1575.82 | 789.02 | 1576.83 | 788.92 | 526.28 |
| SP87 | Ac-F$r8AYWEAL$AANleA-NH2 | 96 | | 1557.86 | 780.14 | 1558.87 | 779.94 | 520.29 |
| SP88 | Ac-F$r8AYWEAL$AAIa-NH2 | 97 | | 1557.86 | 780.33 | 1558.87 | 779.94 | 520.29 |
| SP89 | Ac-F$r8AYWEAL$AAMa-NH2 | 98 | | 1575.82 | 789.3 | 1576.83 | 788.92 | 526.28 |
| SP90 | Ac-F$r8AYWEAL$AANlea-NH2 | 99 | | 1557.86 | 779.4 | 1558.87 | 779.94 | 520.29 |
| SP91 | Ac-F$r8AYWEAL$AAIv-NH2 | 100 | | 1585.89 | 794.29 | 1586.9 | 793.95 | 529.64 |
| SP92 | Ac-F$r8AYWEAL$AAMv-NH2 | 101 | | 1603.85 | 803.08 | 1604.86 | 802.93 | 535.62 |
| SP93 | Ac-F$r8AYWEAL$AANlev-NH2 | 102 | | 1585.89 | 793.46 | 1586.9 | 793.95 | 529.64 |
| SP94 | Ac-F$r8AYWEAL$AAIl-NH2 | 103 | | 1599.91 | 800.49 | 1600.92 | 800.96 | 534.31 |
| SP95 | Ac-F$r8AYWEAL$AAMl-NH2 | 104 | | 1617.86 | 809.44 | 1618.87 | 809.94 | 540.29 |
| SP96 | Ac-F$r8AYWEAL$AANlel-NH2 | 105 | | 1599.91 | 801.7 | 1600.92 | 800.96 | 534.31 |
| SP97 | Ac-F$r8AYWEAL$AANlel-NH2 | 106 | iso2 | 1599.91 | 801.42 | 1600.92 | 800.96 | 534.31 |
| SP98 | Ac-LTF$r8AY6clWAQL$SAA-NH2 | 107 | | 1707.88 | 855.72 | 1708.89 | 854.95 | 570.3 |
| SP99 | Ac-LTF$r8AY6clWAQL$SAA-NH2 | 108 | iso2 | 1707.88 | 855.35 | 1708.89 | 854.95 | 570.3 |
| SP100 | Ac-WTF$r8FYWSQL$AVAa-NH2 | 109 | | 1922.01 | 962.21 | 1923.02 | 962.01 | 641.68 |
| SP101 | Ac-WTF$r8FYWSQL$AVAa-NH2 | 110 | iso2 | 1922.01 | 962.49 | 1923.02 | 962.01 | 641.68 |
| SP102 | Ac-WTF$r8VYWSQL$AVA-NH2 | 111 | | 1802.98 | 902.72 | 1803.99 | 902.5 | 602 |
| SP103 | Ac-WTF$r8VYWSQL$AVA-NH2 | 112 | iso2 | 1802.98 | 903 | 1803.99 | 902.5 | 602 |
| SP104 | Ac-WTF$r8FYWSQL$SAAa-NH2 | 113 | | 1909.98 | 956.47 | 1910.99 | 956 | 637.67 |
| SP105 | Ac-WTF$r8FYWSQL$SAAa-NH2 | 114 | iso2 | 1909.98 | 956.47 | 1910.99 | 956 | 637.67 |
| SP106 | Ac-WTF$r8VYWSQL$AVAaa-NH2 | 115 | | 1945.05 | 974.15 | 1946.06 | 973.53 | 649.36 |
| SP107 | Ac-WTF$r8VYWSQL$AVAaa-NH2 | 116 | iso2 | 1945.05 | 973.78 | 1946.06 | 973.53 | 649.36 |
| SP108 | Ac-LTF$r8AYWAQL$AVG-NH2 | 117 | | 1671.94 | 837.52 | 1672.95 | 836.98 | 558.32 |
| SP109 | Ac-LTF$r8AYWAQL$AVG-NH2 | 118 | iso2 | 1671.94 | 837.21 | 1672.95 | 836.98 | 558.32 |
| SP110 | Ac-LTF$r8AYWAQL$AVQ-NH2 | 119 | | 1742.98 | 872.74 | 1743.99 | 872.5 | 582 |
| SP111 | Ac-LTF$r8AYWAQL$AVQ-NH2 | 120 | iso2 | 1742.98 | 872.74 | 1743.99 | 872.5 | 582 |

TABLE 3-continued

| SP | Sequence | SEQ ID NO: | Isomer | Exact Mass | Found Mass | Calc (M + 1)/1 | Calc (M + 2)/2 | Calc (M + 3)/3 |
|---|---|---|---|---|---|---|---|---|
| SP112 | Ac-LTF$r8AYWAQL$SAa-NH2 | 121 | | 1673.92 | 838.23 | 1674.93 | 837.97 | 558.98 |
| SP113 | Ac-LTF$r8AYWAQL$SAa-NH2 | 122 | iso2 | 1673.92 | 838.32 | 1674.93 | 837.97 | 558.98 |
| SP114 | Ac-LTF$r8AYWAQhL$SAA-NH2 | 123 | | 1687.93 | 844.37 | 1688.94 | 844.97 | 563.65 |
| SP115 | Ac-LTF$r8AYWAQhL$SAA-NH2 | 124 | iso2 | 1687.93 | 844.81 | 1688.94 | 844.97 | 563.65 |
| SP116 | Ac-LTF$r8AYWEQLStSA$-NH2 | 125 | | 1826 | 905.27 | 1827.01 | 914.01 | 609.67 |
| SP117 | Ac-LTF$r8AYWAQL$SLA-NH2 | 126 | | 1715.97 | 858.48 | 1716.98 | 858.99 | 573 |
| SP118 | Ac-LTF$r8AYWAQL$SLA-NH2 | 127 | iso2 | 1715.97 | 858.87 | 1716.98 | 858.99 | 573 |
| SP119 | Ac-LTF$r8AYWAQL$SWA-NH2 | 128 | | 1788.96 | 895.21 | 1789.97 | 895.49 | 597.33 |
| SP120 | Ac-LTF$r8AYWAQL$SWA-NH2 | 129 | iso2 | 1788.96 | 895.28 | 1789.97 | 895.49 | 597.33 |
| SP121 | Ac-LTF$r8AYWAQL$SVS-NH2 | 130 | | 1717.94 | 859.84 | 1718.95 | 859.98 | 573.65 |
| SP122 | Ac-LTF$r8AYWAQL$SAS-NH2 | 131 | | 1689.91 | 845.85 | 1690.92 | 845.96 | 564.31 |
| SP123 | Ac-LTF$r8AYWAQL$SVG-NH2 | 132 | | 1687.93 | 844.81 | 1688.94 | 844.97 | 563.65 |
| SP124 | Ac-ETF$r8VYWAQL$SSa-NH2 | 133 | | 1717.91 | 859.76 | 1718.92 | 859.96 | 573.64 |
| SP125 | Ac-ETF$r8VYWAQL$SAA-NH2 | 134 | | 1717.91 | 859.84 | 1718.92 | 859.96 | 573.64 |
| SP126 | Ac-ETF$r8VYWAQL$SVA-NH2 | 135 | | 1745.94 | 873.82 | 1746.95 | 873.98 | 582.99 |
| SP127 | Ac-ETF$r8VYWAQL$SLA-NH2 | 136 | | 1759.96 | 880.85 | 1760.97 | 880.99 | 587.66 |
| SP128 | Ac-ETF$r8VYWAQL$SWA-NH2 | 137 | | 1832.95 | 917.34 | 1833.96 | 917.48 | 611.99 |
| SP129 | Ac-ETF$r8KYWAQL$SWA-NH2 | 138 | | 1861.98 | 931.92 | 1862.99 | 932 | 621.67 |
| SP130 | Ac-ETF$r8VYWAQL$SVS-NH2 | 139 | | 1761.93 | 881.89 | 1762.94 | 881.97 | 588.32 |
| SP131 | Ac-ETF$r8VYWAQL$SAS-NH2 | 140 | | 1733.9 | 867.83 | 1734.91 | 867.96 | 578.97 |
| SP132 | Ac-ETF$r8VYWAQL$SVG-NH2 | 141 | | 1731.92 | 866.87 | 1732.93 | 866.97 | 578.31 |
| SP133 | Ac-LTF$r8VYWAQL$SSa-NH2 | 142 | | 1717.94 | 859.47 | 1718.95 | 859.98 | 573.65 |
| SP134 | Ac-ETF$r8VYWAQL$SSa-NH2 | 143 | | 1733.9 | 867.83 | 1734.91 | 867.96 | 578.97 |
| SP135 | Ac-LTF$r8VYWAQL$SNa-NH2 | 144 | | 1744.96 | 873.38 | 1745.97 | 873.49 | 582.66 |
| SP136 | Ac-ETF$r8VYWAQL$SNa-NH2 | 145 | | 1760.91 | 881.3 | 1761.92 | 881.46 | 587.98 |
| SP137 | Ac-LTF$r8VYWAQL$SAa-NH2 | 146 | | 1701.95 | 851.84 | 1702.96 | 851.98 | 568.32 |
| SP138 | Ac-LTF$r8VYWAQL$SVA-NH2 | 147 | | 1729.98 | 865.53 | 1730.99 | 866 | 577.67 |
| SP139 | Ac-LTF$r8VYWAQL$SVA-NH2 | 148 | iso2 | 1729.98 | 865.9 | 1730.99 | 866 | 577.67 |
| SP140 | Ac-LTF$r8VYWAQL$SWA-NH2 | 149 | | 1816.99 | 909.42 | 1818 | 909.5 | 606.67 |
| SP141 | Ac-LTF$r8VYWAQL$SVS-NH2 | 150 | | 1745.98 | 873.9 | 1746.99 | 874 | 583 |
| SP142 | Ac-LTF$r8VYWAQL$SVS-NH2 | 151 | iso2 | 1745.98 | 873.9 | 1746.99 | 874 | 583 |
| SP143 | Ac-LTF$r8VYWAQL$SAS-NH2 | 152 | | 1717.94 | 859.84 | 1718.95 | 859.98 | 573.65 |
| SP144 | Ac-LTF$r8VYWAQL$SAS-NH2 | 153 | iso2 | 1717.94 | 859.91 | 1718.95 | 859.98 | 573.65 |
| SP145 | Ac-LTF$r8VYWAQL$SVG-NH2 | 154 | | 1715.97 | 858.87 | 1716.98 | 858.99 | 573 |
| SP146 | Ac-LTF$r8VYWAQL$SVG-NH2 | 155 | iso2 | 1715.97 | 858.87 | 1716.98 | 858.99 | 573 |
| SP147 | Ac-LTF$r8EYWAQCha$SAA-NH2 | 156 | | 1771.96 | 886.85 | 1772.97 | 886.99 | 591.66 |
| SP148 | Ac-LTF$r8EYWAQCha$SAA-NH2 | 157 | iso2 | 1771.96 | 886.85 | 1772.97 | 886.99 | 591.66 |
| SP149 | Ac-LTF$r8EYWAQCpg$SAA-NH2 | 158 | | 1743.92 | 872.86 | 1744.93 | 872.97 | 582.31 |
| SP150 | Ac-LTF$r8EYWAQCpg$SAA-NH2 | 159 | iso2 | 1743.92 | 872.86 | 1744.93 | 872.97 | 582.31 |
| SP151 | Ac-LTF$r8EYWAQF$SAA-NH2 | 160 | | 1765.91 | 883.44 | 1766.92 | 883.96 | 589.64 |
| SP152 | Ac-LTF$r8EYWAQF$SAA-NH2 | 161 | iso2 | 1765.91 | 883.89 | 1766.92 | 883.96 | 589.64 |
| SP153 | Ac-LTF$r8EYWAQCba$SAA-NH2 | 162 | | 1743.92 | 872.42 | 1744.93 | 872.97 | 582.31 |
| SP154 | Ac-LTF$r8EYWAQCba$SAA-NH2 | 163 | iso2 | 1743.92 | 873.39 | 1744.93 | 872.97 | 582.31 |
| SP155 | Ac-LTF3Cl$r8EYWAQL$SAA-NH2 | 164 | | 1765.89 | 883.89 | 1766.9 | 883.95 | 589.64 |
| SP156 | Ac-LTF3Cl$r8EYWAQL$SAA-NH2 | 165 | iso2 | 1765.89 | 883.96 | 1766.9 | 883.95 | 589.64 |
| SP157 | Ac-LTF34F2$r8EYWAQL$SAA-NH2 | 166 | | 1767.91 | 884.48 | 1768.92 | 884.96 | 590.31 |
| SP158 | Ac-LTF34F2$r8EYWAQL$SAA-NH2 | 167 | iso2 | 1767.91 | 884.48 | 1768.92 | 884.96 | 590.31 |
| SP159 | Ac-LTF34F2$r8EYWAQhL$SAA-NH2 | 168 | | 1781.92 | 891.44 | 1782.93 | 891.97 | 594.98 |
| SP160 | Ac-LTF34F2$r8EYWAQhL$SAA-NH2 | 169 | iso2 | 1781.92 | 891.88 | 1782.93 | 891.97 | 594.98 |
| SP161 | Ac-ETF$r8EYWAQL$SAA-NH2 | 170 | | 1747.88 | 874.34 | 1748.89 | 874.95 | 583.63 |
| SP162 | Ac-LTF$r8AYWVQL$SAA-NH2 | 171 | | 1701.95 | 851.4 | 1702.96 | 851.98 | 568.32 |
| SP163 | Ac-LTF$r8AHWAQL$SAA-NH2 | 172 | | 1647.91 | 824.83 | 1648.92 | 824.96 | 550.31 |
| SP164 | Ac-LTF$r8AEWAQL$SAA-NH2 | 173 | | 1639.9 | 820.39 | 1640.91 | 820.96 | 547.64 |
| SP165 | Ac-LTF$r8ASWAQL$SAA-NH2 | 174 | | 1597.89 | 799.36 | 1598.9 | 799.95 | 533.64 |
| SP166 | Ac-LTF$r8AEWAQL$SAA-NH2 | 175 | iso2 | 1639.9 | 820.39 | 1640.91 | 820.96 | 547.64 |
| SP167 | Ac-LTF$r8ASWAQL$SAA-NH2 | 176 | iso2 | 1597.89 | 800.31 | 1598.9 | 799.95 | 533.64 |
| SP168 | Ac-LTF$r8AF4coohWAQL$SAA-NH2 | 177 | | 1701.91 | 851.4 | 1702.92 | 851.96 | 568.31 |
| SP169 | Ac-LTF$r8AF4coohWAQL$SAA-NH2 | 178 | iso2 | 1701.91 | 851.4 | 1702.92 | 851.96 | 568.31 |
| SP170 | Ac-LTF$r8AHWAQL$SAAIa-NH2 | 179 | | 1745 | 874.13 | 1746.01 | 873.51 | 582.67 |
| SP171 | Ac-ITF$r8FYWAQL$AAIa-NH2 | 180 | | 1847.04 | 923.92 | 1848.05 | 924.53 | 616.69 |
| SP172 | Ac-ITF$r8EHWAQL$AAIa-NH2 | 181 | | 1803.01 | 903.17 | 1804.02 | 902.51 | 602.01 |
| SP173 | Ac-ITF$r8EHWAQL$AAIa-NH2 | 182 | iso2 | 1803.01 | 903.17 | 1804.02 | 902.51 | 602.01 |
| SP174 | Ac-ETF$r8EHWAQL$AAIa-NH2 | 183 | | 1818.97 | 910.76 | 1819.98 | 910.49 | 607.33 |
| SP175 | Ac-ETF$r8EHWAQL$AAIa-NH2 | 184 | iso2 | 1818.97 | 910.85 | 1819.98 | 910.49 | 607.33 |
| SP176 | Ac-LTF$r8AHWVQL$AAIa-NH2 | 185 | | 1773.03 | 888.09 | 1774.04 | 887.52 | 592.02 |
| SP177 | Ac-ITF$r8FYWVQL$AAIa-NH2 | 186 | | 1875.07 | 939.16 | 1876.08 | 938.54 | 626.03 |
| SP178 | Ac-ITF$r8EYWVQL$AAIa-NH2 | 187 | | 1857.04 | 929.83 | 1858.05 | 929.53 | 620.02 |
| SP179 | Ac-ITF$r8EHWVQL$AAIa-NH2 | 188 | | 1831.04 | 916.86 | 1832.05 | 916.53 | 611.35 |
| SP180 | Ac-LTF$r8AEWAQL$AAIa-NH2 | 189 | | 1736.99 | 869.87 | 1738 | 869.5 | 580 |
| SP181 | Ac-LTF$r8AF4coohWAQL$AAIa-NH2 | 190 | | 1799 | 900.17 | 1800.01 | 900.51 | 600.67 |
| SP182 | Ac-LTF$r8AF4coohWAQL$AAIa-NH2 | 191 | iso2 | 1799 | 900.24 | 1800.01 | 900.51 | 600.67 |
| SP183 | Ac-LTF$r8AHWAQL$AHFA-NH2 | 192 | | 1845.01 | 923.89 | 1846.02 | 923.51 | 616.01 |
| SP184 | Ac-ITF$r8FYWAQL$AHFA-NH2 | 193 | | 1947.05 | 975.05 | 1948.06 | 974.53 | 650.02 |
| SP185 | Ac-ITF$r8FYWAQL$AHFA-NH2 | 194 | iso2 | 1947.05 | 976.07 | 1948.06 | 974.53 | 650.02 |
| SP186 | Ac-ITF$r8FHWAQL$AEFA-NH2 | 195 | | 1913.02 | 958.12 | 1914.03 | 957.52 | 638.68 |
| SP187 | Ac-ITF$r8FHWAQL$AEFA-NH2 | 196 | iso2 | 1913.02 | 957.86 | 1914.03 | 957.52 | 638.68 |

TABLE 3-continued

| SP | Sequence | SEQ ID NO: | Isomer | Exact Mass | Found Mass | Calc (M + 1)/1 | Calc (M + 2)/2 | Calc (M + 3)/3 |
|---|---|---|---|---|---|---|---|---|
| SP188 | Ac-ITF$r8EHWAQL$AHFA-NH2 | 197 | | 1903.01 | 952.94 | 1904.02 | 952.51 | 635.34 |
| SP189 | Ac-ITF$r8EHWAQL$AHFA-NH2 | 198 | iso2 | 1903.01 | 953.87 | 1904.02 | 952.51 | 635.34 |
| SP190 | Ac-LTF$r8AHWVQL$AHFA-NH2 | 199 | | 1873.04 | 937.86 | 1874.05 | 937.53 | 625.35 |
| SP191 | Ac-ITF$r8FYWVQL$AHFA-NH2 | 200 | | 1975.08 | 988.83 | 1976.09 | 988.55 | 659.37 |
| SP192 | Ac-ITF$r8EYWVQL$AHFA-NH2 | 201 | | 1957.05 | 979.35 | 1958.06 | 979.53 | 653.36 |
| SP193 | Ac-ITF$r8EHWVQL$AHFA-NH2 | 202 | | 1931.05 | 967 | 1932.06 | 966.53 | 644.69 |
| SP194 | Ac-ITF$r8EHWVQL$AHFA-NH2 | 203 | iso2 | 1931.05 | 967.93 | 1932.06 | 966.53 | 644.69 |
| SP195 | Ac-ETF$r8EYWAAL$SAA-NH2 | 204 | | 1690.86 | 845.85 | 1691.87 | 846.44 | 564.63 |
| SP196 | Ac-LTF$r8AYWVAL$SAA-NH2 | 205 | | 1644.93 | 824.08 | 1645.94 | 823.47 | 549.32 |
| SP197 | Ac-LTF$r8AHWAAL$SAA-NH2 | 206 | | 1590.89 | 796.88 | 1591.9 | 796.45 | 531.3 |
| SP198 | Ac-LTF$r8AEWAAL$SAA-NH2 | 207 | | 1582.88 | 791.9 | 1583.89 | 792.45 | 528.63 |
| SP199 | Ac-LTF$r8AEWAAL$SAA-NH2 | 208 | iso2 | 1582.88 | 791.9 | 1583.89 | 792.45 | 528.63 |
| SP200 | Ac-LTF$r8ASWAAL$SAA-NH2 | 209 | | 1540.87 | 770.74 | 1541.88 | 771.44 | 514.63 |
| SP201 | Ac-LTF$r8ASWAAL$SAA-NH2 | 210 | iso2 | 1540.87 | 770.88 | 1541.88 | 771.44 | 514.63 |
| SP202 | Ac-LTF$r8AYWAAL$AAIa-NH2 | 211 | | 1713.99 | 857.39 | 1715 | 858 | 572.34 |
| SP203 | Ac-LTF$r8AYWAAL$AAIa-NH2 | 212 | iso2 | 1713.99 | 857.84 | 1715 | 858 | 572.34 |
| SP204 | Ac-LTF$r8AYWAAL$AHFA-NH2 | 213 | | 1813.99 | 907.86 | 1815 | 908 | 605.67 |
| SP205 | Ac-LTF$r8EHWAQL$AHIa-NH2 | 214 | | 1869.03 | 936.1 | 1870.04 | 935.52 | 624.02 |
| SP206 | Ac-LTF$r8EHWAQL$AHIa-NH2 | 215 | iso2 | 1869.03 | 937.03 | 1870.04 | 935.52 | 624.02 |
| SP207 | Ac-LTF$r8AHWAQL$AHIa-NH2 | 216 | | 1811.03 | 906.87 | 1812.04 | 906.52 | 604.68 |
| SP208 | Ac-LTF$r8EYWAQL$AHIa-NH2 | 217 | | 1895.04 | 949.15 | 1896.05 | 948.53 | 632.69 |
| SP209 | Ac-LTF$r8AYWAQL$AAFa-NH2 | 218 | | 1804.99 | 903.2 | 1806 | 903.5 | 602.67 |
| SP210 | Ac-LTF$r8AYWAQL$AAFa-NH2 | 219 | iso2 | 1804.99 | 903.28 | 1806 | 903.5 | 602.67 |
| SP211 | Ac-LTF$r8AYWAQL$AAWa-NH2 | 220 | | 1844 | 922.81 | 1845.01 | 923.01 | 615.67 |
| SP212 | Ac-LTF$r8AYWAQL$AAVa-NH2 | 221 | | 1756.99 | 878.86 | 1758 | 879.5 | 586.67 |
| SP213 | Ac-LTF$r8AYWAQL$AAVa-NH2 | 222 | iso2 | 1756.99 | 879.3 | 1758 | 879.5 | 586.67 |
| SP214 | Ac-LTF$r8AYWAQL$AALa-NH2 | 223 | | 1771.01 | 886.26 | 1772.02 | 886.51 | 591.34 |
| SP215 | Ac-LTF$r8AYWAQL$AALa-NH2 | 224 | iso2 | 1771.01 | 886.33 | 1772.02 | 886.51 | 591.34 |
| SP216 | Ac-LTF$r8EYWAQL$AAIa-NH2 | 225 | | 1829.01 | 914.89 | 1830.02 | 915.51 | 610.68 |
| SP217 | Ac-LTF$r8EYWAQL$AAIa-NH2 | 226 | iso2 | 1829.01 | 915.34 | 1830.02 | 915.51 | 610.68 |
| SP218 | Ac-LTF$r8EYWAQL$AAFa-NH2 | 227 | | 1863 | 932.87 | 1864.01 | 932.51 | 622.01 |
| SP219 | Ac-LTF$r8EYWAQL$AAFa-NH2 | 228 | iso2 | 1863 | 932.87 | 1864.01 | 932.51 | 622.01 |
| SP220 | Ac-LTF$r8EYWAQL$AAVa-NH2 | 229 | | 1815 | 908.23 | 1816.01 | 908.51 | 606.01 |
| SP221 | Ac-LTF$r8EYWAQL$AAVa-NH2 | 230 | iso2 | 1815 | 908.31 | 1816.01 | 908.51 | 606.01 |
| SP222 | Ac-LTF$r8EHWAQL$AAIa-NH2 | 231 | | 1803.01 | 903.17 | 1804.02 | 902.51 | 602.01 |
| SP223 | Ac-LTF$r8EHWAQL$AAIa-NH2 | 232 | iso2 | 1803.01 | 902.8 | 1804.02 | 902.51 | 602.01 |
| SP224 | Ac-LTF$r8EHWAQL$AAWa-NH2 | 233 | | 1876 | 939.34 | 1877.01 | 939.01 | 626.34 |
| SP225 | Ac-LTF$r8EHWAQL$AAWa-NH2 | 234 | iso2 | 1876 | 939.62 | 1877.01 | 939.01 | 626.34 |
| SP226 | Ac-LTF$r8EHWAQL$AALa-NH2 | 235 | | 1803.01 | 902.8 | 1804.02 | 902.51 | 602.01 |
| SP227 | Ac-LTF$r8EHWAQL$AALa-NH2 | 236 | iso2 | 1803.01 | 902.9 | 1804.02 | 902.51 | 602.01 |
| SP228 | Ac-ETF$r8EHWVQL$AALa-NH2 | 237 | | 1847 | 924.82 | 1848.01 | 924.51 | 616.67 |
| SP229 | Ac-LTF$r8AYWAQL$AAAa-NH2 | 238 | | 1728.96 | 865.89 | 1729.97 | 865.49 | 577.33 |
| SP230 | Ac-LTF$r8AYWAQL$AAAa-NH2 | 239 | iso2 | 1728.96 | 865.89 | 1729.97 | 865.49 | 577.33 |
| SP231 | Ac-LTF$r8AYWAQL$AAAibA-NH2 | 240 | | 1742.98 | 872.83 | 1743.99 | 872.5 | 582 |
| SP232 | Ac-LTF$r8AYWAQL$AAAibA-NH2 | 241 | iso2 | 1742.98 | 872.92 | 1743.99 | 872.5 | 582 |
| SP233 | Ac-LTF$r8AYWAQL$AAAAa-NH2 | 242 | | 1800 | 901.42 | 1801.01 | 901.01 | 601.01 |
| SP234 | Ac-LTF$r5AYWAQL$s8AAIa-NH2 | 243 | | 1771.01 | 887.17 | 1772.02 | 886.51 | 591.34 |
| SP235 | Ac-LTF$r5AYWAQL$s8SAA-NH2 | 244 | | 1673.92 | 838.33 | 1674.93 | 837.97 | 558.98 |
| SP236 | Ac-LTF$r8AYWAQCba$AANleA-NH2 | 245 | | 1783.01 | 892.64 | 1784.02 | 892.51 | 595.34 |
| SP237 | Ac-ETF$r8AYWAQCba$AANleA-NH2 | 246 | | 1798.97 | 900.59 | 1799.98 | 900.49 | 600.66 |
| SP238 | Ac-LTF$r8EYWAQCba$AANleA-NH2 | 247 | | 1841.01 | 922.05 | 1842.02 | 921.51 | 614.68 |
| SP239 | Ac-LTF$r8AYWAQCba$AWNleA-NH2 | 248 | | 1898.05 | 950.46 | 1899.06 | 950.03 | 633.69 |
| SP240 | Ac-ETF$r8AYWAQCba$AWNleA-NH2 | 249 | | 1914.01 | 958.11 | 1915.02 | 958.01 | 639.01 |
| SP241 | Ac-LTF$r8EYWAQCba$AWNleA-NH2 | 250 | | 1956.06 | 950.52 | 1957.07 | 979.04 | 653.03 |
| SP242 | Ac-LTF$r8EYWAQCba$SAFA-NH2 | 251 | | 1890.99 | 946.55 | 1892 | 946.5 | 631.34 |
| SP243 | Ac-LTF34F2$r8EYWAQCba$SANleA-NH2 | 252 | | 1892.99 | 947.57 | 1894 | 947.5 | 632 |
| SP244 | Ac-LTF$r8EF4coohWAQCba$SANleA-NH2 | 253 | | 1885 | 943.59 | 1886.01 | 943.51 | 629.34 |
| SP245 | Ac-LTF$r8EYWSQCba$SANleA-NH2 | 254 | | 1873 | 937.58 | 1874.01 | 937.51 | 625.34 |
| SP246 | Ac-LTF$r8EYWWQCba$SANleA-NH2 | 255 | | 1972.05 | 987.61 | 1973.06 | 987.03 | 658.36 |
| SP247 | Ac-LTF$r8EYWAQCba$AAIa-NH2 | 256 | | 1841.01 | 922.05 | 1842.02 | 921.51 | 614.68 |
| SP248 | Ac-LTF34F2$r8EYWAQCba$AAIa-NH2 | 257 | | 1876.99 | 939.99 | 1878 | 939.5 | 626.67 |
| SP249 | Ac-LTF$r8EF4coohWAQCba$AAIa-NH2 | 258 | | 1869.01 | 935.64 | 1870.02 | 935.51 | 624.01 |
| SP250 | Pam-ETF$r8EYWAQCba$SAA-NH2 | 259 | | 1956.1 | 979.57 | 1957.11 | 979.06 | 653.04 |
| SP251 | Ac-LThF$r8EFWAQCba$SAA-NH2 | 260 | | 1741.94 | 872.11 | 1742.95 | 871.98 | 581.65 |
| SP252 | Ac-LTA$r8EYWAQCba$SAA-NH2 | 261 | | 1667.89 | 835.4 | 1668.9 | 834.95 | 556.97 |
| SP253 | Ac-LTF$r8EYAAQCba$SAA-NH2 | 262 | | 1628.88 | 815.61 | 1629.89 | 815.45 | 543.97 |
| SP254 | Ac-LTF$r8EY2NalAQCba$SAA-NH2 | 263 | | 1754.93 | 879.04 | 1755.94 | 878.47 | 585.98 |
| SP255 | Ac-LTF$r8AYWAQCba$SAA-NH2 | 264 | | 1685.92 | 844.71 | 1686.93 | 843.97 | 562.98 |
| SP256 | Ac-LTF$r8EYWAQCba$SAF-NH2 | 265 | | 1819.96 | 911.41 | 1820.97 | 910.99 | 607.66 |
| SP257 | Ac-LTF$r8EYWAQCba$SAFa-NH2 | 266 | | 1890.99 | 947.41 | 1892 | 946.5 | 631.34 |
| SP258 | Ac-LTF$r8EYWAQCba$SAF-NH2 | 267 | | 1761.95 | 882.57 | 1762.96 | 881.98 | 588.32 |
| SP259 | Ac-LTF34F2$r8AYWAQCba$SAF-NH2 | 268 | | 1797.93 | 900.87 | 1798.94 | 899.97 | 600.32 |
| SP260 | Ac-LTF$r8AF4coohWAQCba$SAF-NH2 | 269 | | 1789.94 | 896.43 | 1790.95 | 895.98 | 597.65 |
| SP261 | Ac-LTF$r8EY6clWAQCba$SAF-NH2 | 270 | | 1853.92 | 929.27 | 1854.93 | 927.97 | 618.98 |
| SP262 | Ac-LTF$r8AYWSQCba$SAF-NH2 | 271 | | 1777.94 | 890.87 | 1778.95 | 889.98 | 593.65 |
| SP263 | Ac-LTF$r8AYWWQCba$SAF-NH2 | 272 | | 1876.99 | 939.91 | 1878 | 939.5 | 626.67 |

TABLE 3-continued

| SP | Sequence | SEQ ID NO: | Isomer | Exact Mass | Found Mass | Calc (M + 1)/1 | Calc (M + 2)/2 | Calc (M + 3)/3 |
|---|---|---|---|---|---|---|---|---|
| SP264 | Ac-LTF$r8AYWAQCba$AAIa-NH2 | 273 | | 1783.01 | 893.19 | 1784.02 | 892.51 | 595.34 |
| SP265 | Ac-LTF34F2$r8AYWAQCba$AAIa-NH2 | 274 | | 1818.99 | 911.23 | 1820 | 910.5 | 607.34 |
| SP266 | Ac-LTF$r8AY6clWAQCba$AAIa-NH2 | 275 | | 1816.97 | 909.84 | 1817.98 | 909.49 | 606.66 |
| SP267 | Ac-LTF$r8AF4coohWAQCba$AAIa-NH2 | 276 | | 1811 | 906.88 | 1812.01 | 906.51 | 604.67 |
| SP268 | Ac-LTF$r8EYWAQCba$AAFa-NH2 | 277 | | 1875 | 938.6 | 1876.01 | 938.51 | 626.01 |
| SP269 | Ac-LTF$r8EYWAQCba$AAFa-NH2 | 278 | iso2 | 1875 | 938.6 | 1876.01 | 938.51 | 626.01 |
| SP270 | Ac-ETF$r8AYWAQCba$AWNlea-NH2 | 279 | | 1914.01 | 958.42 | 1915.02 | 958.01 | 639.01 |
| SP271 | Ac-LTF$r8EYWAQCba$AWNlea-NH2 | 280 | | 1956.06 | 979.42 | 1957.07 | 979.04 | 653.03 |
| SP272 | Ac-ETF$r8EYWAQCba$AWNlea-NH2 | 281 | | 1972.01 | 987.06 | 1973.02 | 987.01 | 658.34 |
| SP273 | Ac-ETF$r8EYWAQCba$AWNlea-NH2 | 282 | iso2 | 1972.01 | 987.06 | 1973.02 | 987.01 | 658.34 |
| SP274 | Ac-LTF$r8AYWAQCba$SAFa-NH2 | 283 | | 1832.99 | 917.89 | 1834 | 917.5 | 612 |
| SP275 | Ac-LTF$r8AYWAQCba$SAFa-NH2 | 284 | iso2 | 1832.99 | 918.07 | 1834 | 917.5 | 612 |
| SP276 | Ac-LTF$r8AYWAQL$AWNlea-NH2 | 285 | | 1902.01 | 952.22 | 1903.02 | 952.01 | 635.01 |
| SP277 | Ac-LTF$r8EYWAQL$AWNlea-NH2 | 286 | | 1944.06 | 973.5 | 1945.07 | 973.04 | 649.03 |
| SP278 | Ac-ETF$r8EYWAQL$AWNlea-NH2 | 287 | | 1960.01 | 981.46 | 1961.02 | 981.01 | 654.34 |
| SP279 | Dmaac-LTF$r8EYWAQhL$SAA-NH2 | 288 | | 1788.98 | 896.06 | 1789.99 | 895.5 | 597.33 |
| SP280 | Hexac-LTF$r8EYWAQhL$SAA-NH2 | 289 | | 1802 | 902.9 | 1803.01 | 902.01 | 601.67 |
| SP281 | Napac-LTF$r8EYWAQhL$SAA-NH2 | 290 | | 1871.99 | 937.58 | 1873 | 937 | 625 |
| SP282 | Decac-LTF$r8EYWAQhL$SAA-NH2 | 291 | | 1858.06 | 930.55 | 1859.07 | 930.04 | 620.36 |
| SP283 | Admac-LTF$r8EYWAQhL$SAA-NH2 | 292 | | 1866.03 | 934.07 | 1867.04 | 934.02 | 623.02 |
| SP284 | Tmac-LTF$r8EYWAQhL$SAA-NH2 | 293 | | 1787.99 | 895.41 | 1789 | 895 | 597 |
| SP285 | Pam-LTF$r8EYWAQhL$SAA-NH2 | 294 | | 1942.16 | 972.08 | 1943.17 | 972.09 | 648.39 |
| SP286 | Ac-LTF$r8AYWAQCba$AANleA-NH2 | 295 | iso2 | 1783.01 | 892.64 | 1784.02 | 892.51 | 595.34 |
| SP287 | Ac-LTF34F2$r8EYWAQCba$AAIa-NH2 | 296 | iso2 | 1876.99 | 939.62 | 1878 | 939.5 | 626.67 |
| SP288 | Ac-LTF$r8AYWAQCba$SAA-NH2 | 297 | | 1779.91 | 892.07 | 1780.92 | 890.96 | 594.31 |
| SP289 | Ac-LTF34F2$r8EYWAQCba$SAA-NH2 | 298 | iso2 | 1779.91 | 891.61 | 1780.92 | 890.96 | 594.31 |
| SP290 | Ac-LTF$r8EF4coohWAQCba$SAA-NH2 | 299 | | 1771.92 | 887.54 | 1772.93 | 886.97 | 591.65 |
| SP291 | Ac-LTF$r8EF4coohWAQCba$SAA-NH2 | 300 | iso2 | 1771.92 | 887.63 | 1772.93 | 886.97 | 591.65 |
| SP292 | Ac-LTF$r8EYWSQCba$SAA-NH2 | 301 | | 1759.92 | 881.9 | 1760.93 | 880.97 | 587.65 |
| SP293 | Ac-LTF$r8EYWSQCba$SAA-NH2 | 302 | iso2 | 1759.92 | 881.9 | 1760.93 | 880.97 | 587.65 |
| SP294 | Ac-LTF$r8EYWAQhL$SAA-NH2 | 303 | | 1745.94 | 875.05 | 1746.95 | 873.98 | 582.99 |
| SP295 | Ac-LTF$r8AYWAQhL$SAF-NH2 | 304 | | 1763.97 | 884.02 | 1764.98 | 882.99 | 589 |
| SP296 | Ac-LTF$r8AYWAQhL$SAF-NH2 | 305 | iso2 | 1763.97 | 883.56 | 1764.98 | 882.99 | 589 |
| SP297 | Ac-LTF34F2$r8AYWAQhL$SAA-NH2 | 306 | | 1723.92 | 863.67 | 1724.93 | 862.97 | 575.65 |
| SP298 | Ac-LTF34F2$r8AYWAQhL$SAA-NH2 | 307 | iso2 | 1723.92 | 864.04 | 1724.93 | 862.97 | 575.65 |
| SP299 | Ac-LTF$r8AF4coohWAQhL$SAA-NH2 | 308 | | 1715.93 | 859.44 | 1716.94 | 858.97 | 572.98 |
| SP300 | Ac-LTF$r8AF4coohWAQhL$SAA-NH2 | 309 | iso2 | 1715.93 | 859.6 | 1716.94 | 858.97 | 572.98 |
| SP301 | Ac-LTF$r8AYWSQhL$SAA-NH2 | 310 | | 1703.93 | 853.96 | 1704.94 | 852.97 | 568.98 |
| SP302 | Ac-LTF$r8AYWSQhL$SAA-NH2 | 311 | iso2 | 1703.93 | 853.59 | 1704.94 | 852.97 | 568.98 |
| SP303 | Ac-LTF$r8EYWAQL$AANleA-NH2 | 312 | | 1829.01 | 915.45 | 1830.02 | 915.51 | 610.68 |
| SP304 | Ac-LTF34F2$r8AYWAQL$AANleA-NH2 | 313 | | 1806.99 | 904.58 | 1808 | 904.5 | 603.34 |
| SP305 | Ac-LTF$r8AF4coohWAQL$AANleA-NH2 | 314 | | 1799 | 901.6 | 1800.01 | 900.51 | 600.67 |
| SP306 | Ac-LTF$r8AYWSQL$AANleA-NH2 | 315 | | 1787 | 894.75 | 1788.01 | 894.51 | 596.67 |
| SP307 | Ac-LTF34F2$r8AYWAQhL$AANleA-NH2 | 316 | | 1821 | 911.79 | 1822.01 | 911.51 | 608.01 |
| SP308 | Ac-LTF34F2$r8AYWAQhL$AANleA-NH2 | 317 | iso2 | 1821 | 912.61 | 1822.01 | 911.51 | 608.01 |
| SP309 | Ac-LTF$r8AF4coohWAQhL$AANleA-NH2 | 318 | | 1813.02 | 907.95 | 1814.03 | 907.52 | 605.35 |
| SP310 | Ac-LTF$r8AF4coohWAQhL$AANleA-NH2 | 319 | iso2 | 1813.02 | 908.54 | 1814.03 | 907.52 | 605.35 |
| SP311 | Ac-LTF$r8AYWSQhL$AANleA-NH2 | 320 | | 1801.02 | 901.84 | 1802.03 | 901.52 | 601.35 |
| SP312 | Ac-LTF$r8AYWSQhL$AANleA-NH2 | 321 | iso2 | 1801.02 | 902.62 | 1802.03 | 901.52 | 601.35 |
| SP313 | Ac-LTF$r8AYWAQhL$AAAAa-NH2 | 322 | | 1814.01 | 908.63 | 1815.02 | 908.01 | 605.68 |
| SP314 | Ac-LTF$r8AYWAQhL$AAAAa-NH2 | 323 | iso2 | 1814.01 | 908.34 | 1815.02 | 908.01 | 605.68 |
| SP315 | Ac-LTF$r8AYWAQL$AAAAAa-NH2 | 324 | | 1871.04 | 936.94 | 1872.05 | 936.53 | 624.69 |
| SP316 | Ac-LTF$r8AYWAQL$AAAAAAa-NH2 | 325 | iso2 | 1942.07 | 972.5 | 1943.08 | 972.04 | 648.37 |
| SP317 | Ac-LTF$r8AYWAQL$AAAAAAa-NH2 | 326 | iso1 | 1942.07 | 972.5 | 1943.08 | 972.04 | 648.37 |
| SP318 | Ac-LTF$r8EYWAQhL$AANleA-NH2 | 327 | | 1843.03 | 922.54 | 1844.04 | 922.52 | 615.35 |
| SP319 | Ac-AATF$r8AYWAQL$AANleA-NH2 | 328 | | 1800 | 901.39 | 1801.01 | 901.01 | 601.01 |
| SP320 | Ac-LTF$r8AYWAQL$AANleAA-NH2 | 329 | | 1842.04 | 922.45 | 1843.05 | 922.03 | 615.02 |
| SP321 | Ac-ALTF$r8AYWAQL$AANleAA-NH2 | 330 | | 1913.08 | 957.94 | 1914.09 | 957.55 | 638.7 |
| SP322 | Ac-LTF$r8AYWAQCba$AANleAA-NH2 | 331 | | 1854.04 | 928.43 | 1855.05 | 928.03 | 619.02 |
| SP323 | Ac-LTF$r8AYWAQhL$AANleAA-NH2 | 332 | | 1856.06 | 929.4 | 1857.07 | 929.04 | 619.69 |
| SP324 | Ac-LTF$r8EYWAQCba$SAAA-NH2 | 333 | | 1814.96 | 909.37 | 1815.97 | 908.49 | 605.99 |
| SP325 | Ac-LTF$r8EYWAQCba$SAAA-NH2 | 334 | iso2 | 1814.96 | 909.37 | 1815.97 | 908.49 | 605.99 |
| SP326 | Ac-LTF$r8EYWAQCba$SAAAA-NH2 | 335 | | 1886 | 944.61 | 1887.01 | 944.01 | 629.67 |
| SP327 | Ac-LTF$r8EYWAQCba$SAAAA-NH2 | 336 | iso2 | 1886 | 944.61 | 1887.01 | 944.01 | 629.67 |
| SP328 | Ac-ALTF$r8EYWAQCba$SAAA-NH2 | 337 | | 1814.96 | 909.09 | 1815.97 | 908.49 | 605.99 |
| SP329 | Ac-ALTF$r8EYWAQCba$SAAA-NH2 | 338 | | 1886 | 944.61 | 1887.01 | 944.01 | 629.67 |
| SP330 | Ac-LTF$r8EYWAQCba$SAA-NH2 | 339 | iso2 | 1814.96 | 909.09 | 1815.97 | 908.49 | 605.99 |
| SP331 | Ac-LTF$r8EYWAQL$AAAAAa-NH2 | 340 | iso2 | 1929.04 | 966.08 | 1930.05 | 965.53 | 644.02 |
| SP332 | Ac-LTF$r8EY6clWAQCba$SAA-NH2 | 341 | | 1777.89 | 890.78 | 1778.9 | 889.95 | 593.64 |
| SP333 | Ac-LTF$r8EF4cooh6clWAQCba$SANleA-NH2 | 342 | | 1918.96 | 961.27 | 1919.97 | 960.49 | 640.66 |
| SP334 | Ac-LTF$r8EF4cooh6clWAQCba$SANleA-NH2 | 343 | iso2 | 1918.96 | 961.27 | 1919.97 | 960.49 | 640.66 |
| SP335 | Ac-LTF$r8EF4cooh6clWAQCba$AAIa-NH2 | 344 | | 1902.97 | 953.03 | 1903.98 | 952.49 | 635.33 |
| SP336 | Ac-LTF$r8EF4cooh6clWAQCba$AAIa-NH2 | 345 | iso2 | 1902.97 | 953.13 | 1903.98 | 952.49 | 635.33 |
| SP337 | Ac-LTF$r8AY6clWAQL$AAAAAa-NH2 | 346 | | 1905 | 954.61 | 1906.01 | 953.51 | 636.01 |
| SP338 | Ac-LTF$r8AY6clWAQL$AAAAAa-NH2 | 347 | iso2 | 1905 | 954.9 | 1906.01 | 953.51 | 636.01 |
| SP339 | Ac-F$r8AY6clWEAL$AAAAAAa-NH2 | 348 | | 1762.89 | 883.01 | 1763.9 | 882.45 | 588.64 |

TABLE 3-continued

| SP | Sequence | SEQ ID NO: | Isomer | Exact Mass | Found Mass | Calc (M + 1)/1 | Calc (M + 2)/2 | Calc (M + 3)/3 |
|---|---|---|---|---|---|---|---|---|
| SP340 | Ac-ETF$r8EYWAQL$AAAAAa-NH2 | 349 | | 1945 | 974.31 | 1946.01 | 973.51 | 649.34 |
| SP341 | Ac-ETF$r8EYWAQL$AAAAAa-NH2 | 350 | iso2 | 1945 | 974.49 | 1946.01 | 973.51 | 649.34 |
| SP342 | Ac-LTF$r8EYWAQL$AAAAAAa-NH2 | 351 | | 2000.08 | 1001.6 | 2001.09 | 1001.05 | 667.7 |
| SP343 | Ac-LTF$r8EYWAQL$AAAAAAa-NH2 | 352 | iso2 | 2000.08 | 1001.6 | 2001.09 | 1001.05 | 667.7 |
| SP344 | Ac-LTF$r8AYWAQL$AANleAAa-NH2 | 353 | | 1913.08 | 958.58 | 1914.09 | 957.55 | 638.7 |
| SP345 | Ac-LTF$r8AYWAQL$AANleAAa-NH2 | 354 | iso2 | 1913.08 | 958.58 | 1914.09 | 957.55 | 638.7 |
| SP346 | Ac-LTF$r8EYWAQCba$AAAAAa-NH2 | 355 | | 1941.04 | 972.55 | 1942.05 | 971.53 | 648.02 |
| SP347 | Ac-LTF$r8EYWAQCba$AAAAAa-NH2 | 356 | iso2 | 1941.04 | 972.55 | 1942.05 | 971.53 | 648.02 |
| SP348 | Ac-LTF$r8EF4coohWAQCba$AAAAAa-NH2 | 357 | | 1969.04 | 986.33 | 1970.05 | 985.53 | 657.35 |
| SP349 | Ac-LTF$r8EF4coohWAQCba$AAAAAa-NH2 | 358 | iso2 | 1969.04 | 986.06 | 1970.05 | 985.53 | 657.35 |
| SP350 | Ac-LTF$r8EYWSQCba$AAAAAa-NH2 | 359 | | 1957.04 | 980.04 | 1958.05 | 979.53 | 653.35 |
| SP351 | Ac-LTF$r8EYWSQCba$AAAAAa-NH2 | 360 | iso2 | 1957.04 | 980.04 | 1958.05 | 979.53 | 653.35 |
| SP352 | Ac-LTF$r8EYWAQCba$SAAa-NH2 | 361 | | 1814.96 | 909 | 1815.97 | 908.49 | 605.99 |
| SP353 | Ac-LTF$r8EYWAQCba$SAAa-NH2 | 362 | iso2 | 1814.96 | 909 | 1815.97 | 908.49 | 605.99 |
| SP354 | Ac-ALTF$r8EYWAQCba$SAAa-NH2 | 363 | | 1886 | 944.52 | 1887.01 | 944.01 | 629.67 |
| SP355 | Ac-ALTF$r8EYWAQCba$SAAa-NH2 | 364 | iso2 | 1886 | 944.98 | 1887.01 | 944.01 | 629.67 |
| SP356 | Ac-ALTF$r8EYWAQCba$SAAAa-NH2 | 365 | | 1957.04 | 980.04 | 1958.05 | 979.53 | 653.35 |
| SP357 | Ac-ALTF$r8EYWAQCba$SAAAa-NH2 | 366 | iso2 | 1957.04 | 980.04 | 1958.05 | 979.53 | 653.35 |
| SP358 | Ac-AALTF$r8EYWAQCba$SAAAa-NH2 | 367 | | 2028.07 | 1016.1 | 2029.08 | 1015.04 | 677.03 |
| SP359 | Ac-AALTF$r8EYWAQCba$SAAAa-NH2 | 368 | iso2 | 2028.07 | 1015.57 | 2029.08 | 1015.04 | 677.03 |
| SP360 | Ac-RTF$r8EYWAQCba$SAA-NH2 | 369 | | 1786.94 | 895.03 | 1787.95 | 894.48 | 596.65 |
| SP361 | Ac-LRF$r8EYWAQCba$SAA-NH2 | 370 | | 1798.98 | 901.51 | 1799.99 | 900.5 | 600.65 |
| SP362 | Ac-LTF$r8EYWRQCba$SAA-NH2 | 371 | | 1828.99 | 916.4 | 1830 | 915.5 | 610.67 |
| SP363 | Ac-LTF$r8EYWARCba$SAA-NH2 | 372 | | 1771.97 | 887.63 | 1772.98 | 886.99 | 591.66 |
| SP364 | Ac-LTF$r8EYWAQCba$RAA-NH2 | 373 | | 1812.99 | 908.08 | 1814 | 907.5 | 605.34 |
| SP365 | Ac-LTF$r8EYWAQCba$SRA-NH2 | 374 | | 1828.99 | 916.12 | 1830 | 915.5 | 610.67 |
| SP366 | Ac-LTF$r8EYWAQCba$SAR-NH2 | 375 | | 1828.99 | 916.12 | 1830 | 915.5 | 610.67 |
| SP367 | 5-FAM-BaLTF$r8EYWAQCba$SAA-NH2 | 376 | | 2131 | 1067.09 | 2132.01 | 1066.51 | 711.34 |
| SP368 | 5-FAM-BaLTF$r8EYWAQL$AANleA-NH2 | 377 | | 2158.08 | 1080.5 | 2159.09 | 1080.05 | 720.37 |
| SP369 | Ac-LAF$r8EYWAQL$AANleA-NH2 | 378 | | 1799 | 901.05 | 1800.01 | 900.51 | 600.67 |
| SP370 | Ac-ATF$r8EYWAQL$AANleA-NH2 | 379 | | 1786.97 | 895.03 | 1787.98 | 894.49 | 596.66 |
| SP371 | Ac-AAF$r8EYWAQL$AANleA-NH2 | 380 | | 1756.96 | 880.05 | 1757.97 | 879.49 | 586.66 |
| SP372 | Ac-AAAF$r8EYWAQL$AANleA-NH2 | 381 | | 1827.99 | 915.57 | 1829 | 915 | 610.34 |
| SP373 | Ac-AAAAF$r8EYWAQL$AANleA-NH2 | 382 | | 1899.03 | 951.09 | 1900.04 | 950.52 | 634.02 |
| SP374 | Ac-AATF$r8EYWAQL$AANleA-NH2 | 383 | | 1858 | 930.92 | 1859.01 | 930.01 | 620.34 |
| SP375 | Ac-AALTF$r8EYWAQL$AANleA-NH2 | 384 | | 1971.09 | 987.17 | 1972.1 | 986.55 | 658.04 |
| SP376 | Ac-AAALTF$r8EYWAQL$AANleA-NH2 | 385 | | 2042.12 | 1023.15 | 2043.13 | 1022.07 | 681.71 |
| SP377 | Ac-LTF$r8EYWAQL$AANleAA-NH2 | 386 | | 1900.05 | 952.02 | 1901.06 | 951.03 | 634.36 |
| SP378 | Ac-ALTF$r8EYWAQL$AANleAA-NH2 | 387 | | 1971.09 | 987.63 | 1972.1 | 986.55 | 658.04 |
| SP379 | Ac-AALTF$r8EYWAQL$AANleAA-NH2 | 388 | | 2042.12 | 1022.69 | 2043.13 | 1022.07 | 681.71 |
| SP380 | Ac-LTF$r8EYWAQCba$AANleAA-NH2 | 389 | | 1912.05 | 958.03 | 1913.06 | 957.03 | 638.36 |
| SP381 | Ac-LTF$r8EYWAQhL$AANleAA-NH2 | 390 | | 1914.07 | 958.68 | 1915.08 | 958.04 | 639.03 |
| SP382 | Ac-ALTF$r8EYWAQhL$AANleAA-NH2 | 391 | | 1985.1 | 994.1 | 1986.11 | 993.56 | 662.71 |
| SP383 | Ac-LTF$r8ANmYWAQL$AANleA-NH2 | 392 | | 1785.02 | 894.11 | 1786.03 | 893.52 | 596.01 |
| SP384 | Ac-LTF$r8ANmYWAQL$AANleA-NH2 | 393 | iso2 | 1785.02 | 894.11 | 1786.03 | 893.52 | 596.01 |
| SP385 | Ac-LTF$r8AYNmWAQL$AANleA-NH2 | 394 | | 1785.02 | 894.11 | 1786.03 | 893.52 | 596.01 |
| SP386 | Ac-LTF$r8AYNmWAQL$AANleA-NH2 | 395 | iso2 | 1785.02 | 894.11 | 1786.03 | 893.52 | 596.01 |
| SP387 | Ac-LTF$r8AYAmwAQL$AANleA-NH2 | 396 | | 1785.02 | 894.01 | 1786.03 | 893.52 | 596.01 |
| SP388 | Ac-LTF$r8AYAmwAQL$AANleA-NH2 | 397 | iso2 | 1785.02 | 894.01 | 1786.03 | 893.52 | 596.01 |
| SP389 | Ac-LTF$r8AYWAibQL$AANleA-NH2 | 398 | | 1785.02 | 894.01 | 1786.03 | 893.52 | 596.01 |
| SP390 | Ac-LTF$r8AYWAibQL$AANleA-NH2 | 399 | iso2 | 1785.02 | 894.01 | 1786.03 | 893.52 | 596.01 |
| SP391 | Ac-LTF$r8AYWAQL$AAibNleA-NH2 | 400 | | 1785.02 | 894.38 | 1786.03 | 893.52 | 596.01 |
| SP392 | Ac-LTF$r8AYWAQL$AAibNleA-NH2 | 401 | iso2 | 1785.02 | 894.38 | 1786.03 | 893.52 | 596.01 |
| SP393 | Ac-LTF$r8AYWAQL$AaNleA-NH2 | 402 | | 1771.01 | 887.54 | 1772.02 | 886.51 | 591.34 |
| SP394 | Ac-LTF$r8AYWAQL$AaNleA-NH2 | 403 | iso2 | 1771.01 | 887.54 | 1772.02 | 886.51 | 591.34 |
| SP395 | Ac-LTF$r8AYWAQL$ASarNleA-NH2 | 404 | | 1771.01 | 887.35 | 1772.02 | 886.51 | 591.34 |
| SP396 | Ac-LTF$r8AYWAQL$ASarNleA-NH2 | 405 | iso2 | 1771.01 | 887.35 | 1772.02 | 886.51 | 591.34 |
| SP397 | Ac-LTF$r8AYWAQL$AANleAib-NH2 | 406 | | 1785.02 | 894.75 | 1786.03 | 893.52 | 596.01 |
| SP398 | Ac-LTF$r8AYWAQL$AANleAib-NH2 | 407 | iso2 | 1785.02 | 894.75 | 1786.03 | 893.52 | 596.01 |
| SP399 | Ac-LTF$r8AYWAQL$AANleNmA-NH2 | 408 | | 1785.02 | 894.6 | 1786.03 | 893.52 | 596.01 |
| SP400 | Ac-LTF$r8AYWAQL$AANleNmA-NH2 | 409 | iso2 | 1785.02 | 894.6 | 1786.03 | 893.52 | 596.01 |
| SP401 | Ac-LTF$r8AYWAQL$AANleSar-NH2 | 410 | | 1771.01 | 886.98 | 1772.02 | 886.51 | 591.34 |
| SP402 | Ac-LTF$r8AYWAQL$AANleSar-NH2 | 411 | iso2 | 1771.01 | 886.98 | 1772.02 | 886.51 | 591.34 |
| SP403 | Ac-LTF$r8AYWAQL$AANleAAib-NH2 | 412 | | 1856.06 | | 1857.07 | 929.04 | 619.69 |
| SP404 | Ac-LTF$r8AYWAQL$AANleAAib-NH2 | 413 | iso2 | 1856.06 | | 1857.07 | 929.04 | 619.69 |
| SP405 | Ac-LTF$r8AYWAQL$AANleANmA-NH2 | 414 | | 1856.06 | 930.37 | 1857.07 | 929.04 | 619.69 |
| SP406 | Ac-LTF$r8AYWAQL$AANleANmA-NH2 | 415 | iso2 | 1856.06 | 930.37 | 1857.07 | 929.04 | 619.69 |
| SP407 | Ac-LTF$r8AYWAQL$AANleAa-NH2 | 416 | | 1842.04 | 922.69 | 1843.05 | 922.03 | 615.02 |
| SP408 | Ac-LTF$r8AYWAQL$AANleAa-NH2 | 417 | iso2 | 1842.04 | 922.69 | 1843.05 | 922.03 | 615.02 |
| SP409 | Ac-LTF$r8AYWAQL$AANleASar-NH2 | 418 | | 1842.04 | 922.6 | 1843.05 | 922.03 | 615.02 |
| SP410 | Ac-LTF$r8AYWAQL$AANleASar-NH2 | 419 | iso2 | 1842.04 | 922.6 | 1843.05 | 922.03 | 615.02 |
| SP411 | Ac-LTF$/r8AYWAQL$/AANleA-NH2 | 420 | | 1799.04 | 901.14 | 1800.05 | 900.53 | 600.69 |
| SP412 | Ac-LTFAibAYWAQLAibAANleA-NH2 | 421 | | 1648.9 | 826.02 | 1649.91 | 825.46 | 550.64 |
| SP413 | Ac-LTF$r8Cou4YWAQL$AANleA-NH2 | 422 | | 1975.05 | 989.11 | 1976.06 | 988.53 | 659.36 |
| SP414 | Ac-LTF$r8Cou4YWAQL$AANleA-NH2 | 423 | iso2 | 1975.05 | 989.11 | 1976.06 | 988.53 | 659.36 |
| SP415 | Ac-LTF$r8AYWCou4QL$AANleA-NH2 | 424 | | 1975.05 | 989.11 | 1976.06 | 988.53 | 659.36 |

TABLE 3-continued

| SP | Sequence | SEQ ID NO: | Isomer | Exact Mass | Found Mass | Calc (M + 1)/1 | Calc (M + 2)/2 | Calc (M + 3)/3 |
|---|---|---|---|---|---|---|---|---|
| SP416 | Ac-LTF$r8AYWAQL$Cou4ANleA-NH2 | 425 | | 1975.05 | 989.57 | 1976.06 | 988.53 | 659.36 |
| SP417 | Ac-LTF$r8AYWAQL$Cou4ANleA-NH2 | 426 | iso2 | 1975.05 | 989.57 | 1976.06 | 988.53 | 659.36 |
| SP418 | Ac-LTF$r8AYWAQL$ACou4NleA-NH2 | 427 | | 1975.05 | 989.57 | 1976.06 | 988.53 | 659.36 |
| SP419 | Ac-LTF$r8AYWAQL$ACou4NleA-NH2 | 428 | iso2 | 1975.05 | 989.57 | 1976.06 | 988.53 | 659.36 |
| SP420 | Ac-LTF$r8AYWAQL$AANleA-OH | 429 | | 1771.99 | 887.63 | 1773 | 887 | 591.67 |
| SP421 | Ac-LTF$r8AYWAQL$AANleA-OH | 430 | iso2 | 1771.99 | 887.63 | 1773 | 887 | 591.67 |
| SP422 | Ac-LTF$r8AYWAQL$AANleA-NHnPr | 431 | | 1813.05 | 908.08 | 1814.06 | 907.53 | 605.36 |
| SP423 | Ac-LTF$r8AYWAQL$AANleA-NHnPr | 432 | iso2 | 1813.05 | 908.08 | 1814.06 | 907.53 | 605.36 |
| SP424 | Ac-LTF$r8AYWAQL$AANleA-NHnBu33Me | 433 | | 1855.1 | 929.17 | 1856.11 | 928.56 | 619.37 |
| SP425 | Ac-LTF$r8AYWAQL$AANleA-NHnBu33Me | 434 | iso2 | 1855.1 | 929.17 | 1856.11 | 928.56 | 619.37 |
| SP426 | Ac-LTF$r8AYWAQL$AANleA-NHHex | 435 | | 1855.1 | 929.17 | 1856.11 | 928.56 | 619.37 |
| SP427 | Ac-LTF$r8AYWAQL$AANleA-NHHex | 436 | iso2 | 1855.1 | 929.17 | 1856.11 | 928.56 | 619.37 |
| SP428 | Ac-LTA$r8AYWAQL$AANleA-NH2 | 437 | | 1694.98 | 849.33 | 1695.99 | 848.5 | 566 |
| SP429 | Ac-LThL$r8AYWAQL$AANleA-NH2 | 438 | | 1751.04 | 877.09 | 1752.05 | 876.53 | 584.69 |
| SP430 | Ac-LTF$r8AYAAQL$AANleA-NH2 | 439 | | 1655.97 | 829.54 | 1656.98 | 828.99 | 553 |
| SP431 | Ac-LTF$r8AY2NalAQL$AANleA-NH2 | 440 | | 1782.01 | 892.63 | 1783.02 | 892.01 | 595.01 |
| SP432 | Ac-LTF$r8EYWCou4QCba$SAA-NH2 | 441 | | 1947.97 | 975.8 | 1948.98 | 974.99 | 650.33 |
| SP433 | Ac-LTF$r8EYWCou7QCba$SAA-NH2 | 442 | | 16.03 | 974.9 | 17.04 | 9.02 | 6.35 |
| SP434 | Ac-LTF%r8EYWAQCba%SAA-NH2 | 443 | | 1745.94 | 874.8 | 1746.95 | 873.98 | 582.99 |
| SP435 | Dmaac-LTF$r8EYWAQCba$SAA-NH2 | 444 | | 1786.97 | 894.8 | 1787.98 | 894.49 | 596.66 |
| SP436 | Dmaac-LTF$r8AYWAQL$AAAAAa-NH2 | 445 | | 1914.08 | 958.2 | 1915.09 | 958.05 | 639.03 |
| SP437 | Dmaac-LTF$r8AYWAQL$AAAAAa-NH2 | 446 | iso2 | 1914.08 | 958.2 | 1915.09 | 958.05 | 639.03 |
| SP438 | Dmaac-LTF$r8EYWAQL$AAAAAa-NH2 | 447 | | 1972.08 | 987.3 | 1973.09 | 987.05 | 658.37 |
| SP439 | Dmaac-LTF$r8EYWAQL$AAAAAa-NH2 | 448 | iso2 | 1972.08 | 987.3 | 1973.09 | 987.05 | 658.37 |
| SP440 | Dmaac-LTF$r8EF4coohWAQCba$AAIa-NH2 | 449 | | 1912.05 | 957.4 | 1913.06 | 957.03 | 638.36 |
| SP441 | Dmaac-LTF$r8EF4coohWAQCba$AAIa-NH2 | 450 | iso2 | 1912.05 | 957.4 | 1913.06 | 957.03 | 638.36 |
| SP442 | Dmaac-LTF$r8AYWAQL$AANleA-NH2 | 451 | | 1814.05 | 908.3 | 1815.06 | 908.03 | 605.69 |
| SP443 | Dmaac-LTF$r8AYWAQL$AANleA-NH2 | 452 | iso2 | 1814.05 | 908.3 | 1815.06 | 908.03 | 605.69 |
| SP444 | Ac-LTF%r8AYWAQL%AANleA-NH2 | 453 | | 1773.02 | 888.37 | 1774.03 | 887.52 | 592.01 |
| SP445 | Ac-LTF%r8EYWAQL%AAAAAa-NH2 | 454 | | 1931.06 | 966.4 | 1932.07 | 966.54 | 644.69 |
| SP446 | Cou6BaLTF$r8EYWAQhL$SAA-NH2 | 455 | | 2018.05 | 1009.9 | 2019.06 | 1010.01 | 673.69 |
| SP447 | Cou8BaLTF$r8EYWAQhL$SAA-NH2 | 456 | | 1962.96 | 982.34 | 1963.97 | 982.49 | 655.32 |
| SP448 | Ac-LTF4I$r8EYWAQL$AAAAAa-NH2 | 457 | | 2054.93 | 1028.68 | 2055.94 | 1028.47 | 685.98 |
| SP449 | Ac-LTF$r8EYWAQL$AAAAAa-NH2 | 458 | | 1929.04 | 966.17 | 1930.05 | 965.53 | 644.02 |
| SP550 | Ac-LTF$r8EYWAQL$AAAAAa-OH | 459 | | 1930.02 | 966.54 | 1931.03 | 966.02 | 644.35 |
| SP551 | Ac-LTF$r8EYWAQL$AAAAAa-OH | 460 | iso2 | 1930.02 | 965.89 | 1931.03 | 966.02 | 644.35 |
| SP552 | Ac-LTF$r8EYWAEL$AAAAAa-NH2 | 461 | | 1930.02 | 966.82 | 1931.03 | 966.02 | 644.35 |
| SP553 | Ac-LTF$r8EYWAEL$AAAAAa-NH2 | 462 | iso2 | 1930.02 | 966.91 | 1931.03 | 966.02 | 644.35 |
| SP554 | Ac-LTF$r8EYWAEL$AAAAAa-OH | 463 | | 1931.01 | 967.28 | 1932.02 | 966.51 | 644.68 |
| SP555 | Ac-LTF$r8EY6clWAQL$AAAAAa-NH2 | 464 | | 1963 | 983.28 | 1964.01 | 982.51 | 655.34 |
| SP556 | Ac-LTF$r8EF4bOH2WAQL$AAAAAa-NH2 | 465 | | 1957.05 | 980.04 | 1958.06 | 979.53 | 653.36 |
| SP557 | Ac-AAALTF$r8EYWAQL$AAAAAa-NH2 | 466 | | 2142.15 | 1072.83 | 2143.16 | 1072.08 | 715.06 |
| SP558 | Ac-LTF34F2$r8EYWAQL$AAAAAa-NH2 | 467 | | 1965.02 | 984.3 | 1966.03 | 983.52 | 656.01 |
| SP559 | Ac-RTF$r8EYWAQL$AAAAAa-NH2 | 468 | | 1972.04 | 987.81 | 1973.07 | 987.04 | 658.36 |
| SP560 | Ac-LTA$r8EYWAQL$AAAAAa-NH2 | 469 | | 1853.01 | 928.33 | 1854.02 | 927.51 | 618.68 |
| SP561 | Ac-LTF$r8EYWAibQL$AAAAAa-NH2 | 470 | | 1943.06 | 973.48 | 1944.07 | 972.54 | 648.69 |
| SP562 | Ac-LTF$r8EYWAQL$AAibAAAa-NH2 | 471 | | 1943.06 | 973.11 | 1944.07 | 972.54 | 648.69 |
| SP563 | Ac-LTF$r8EYWAQL$AAAibAAa-NH2 | 472 | | 1943.06 | 973.48 | 1944.07 | 972.54 | 648.69 |
| SP564 | Ac-LTF$r8EYWAQL$AAAAibAa-NH2 | 473 | | 1943.06 | 973.48 | 1944.07 | 972.54 | 648.69 |
| SP565 | Ac-LTF$r8EYWAQL$AAAAAiba-NH2 | 474 | | 1943.06 | 973.38 | 1944.07 | 972.54 | 648.69 |
| SP566 | Ac-LTF$r8EYWAQL$AAAAAiba-NH2 | 475 | iso2 | 1943.06 | 973.38 | 1944.07 | 972.54 | 648.69 |
| SP567 | Ac-LTF$r8EYWAQL$AAAAAAib-NH2 | 476 | | 1943.06 | 973.01 | 1944.07 | 972.54 | 648.69 |
| SP568 | Ac-LTF$r8EYWAQL$AaAAAa-NH2 | 477 | | 1929.04 | 966.54 | 1930.05 | 965.53 | 644.02 |
| SP569 | Ac-LTF$r8EYWAQL$AAaAAa-NH2 | 478 | | 1929.04 | 966.35 | 1930.05 | 965.53 | 644.02 |
| SP570 | Ac-LTF$r8EYWAQL$AAAaAa-NH2 | 479 | | 1929.04 | 966.54 | 1930.05 | 965.53 | 644.02 |
| SP571 | Ac-LTF$r8EYWAQL$AAAaAa-NH2 | 480 | iso2 | 1929.04 | 966.35 | 1930.05 | 965.53 | 644.02 |
| SP572 | Ac-LTF$r8EYWAQL$AAAAaa-NH2 | 481 | | 1929.04 | 966.35 | 1930.05 | 965.53 | 644.02 |
| SP573 | Ac-LTF$r8EYWAQL$AAAAAA-NH2 | 482 | | 1929.04 | 966.35 | 1930.05 | 965.53 | 644.02 |
| SP574 | Ac-LTF$r8EYWAQL$ASarAAAa-NH2 | 483 | | 1929.04 | 966.54 | 1930.05 | 965.53 | 644.02 |
| SP575 | Ac-LTF$r8EYWAQL$AASarAAa-NH2 | 484 | | 1929.04 | 966.35 | 1930.05 | 965.53 | 644.02 |
| SP576 | Ac-LTF$r8EYWAQL$AAASarAa-NH2 | 485 | | 1929.04 | 966.35 | 1930.05 | 965.53 | 644.02 |
| SP577 | Ac-LTF$r8EYWAQL$AAAASara-NH2 | 486 | | 1929.04 | 966.35 | 1930.05 | 965.53 | 644.02 |
| SP578 | Ac-LTF$r8EYWAQL$AAAAASar-NH2 | 487 | | 1929.04 | 966.08 | 1930.05 | 965.53 | 644.02 |
| SP579 | Ac-7LTF$r8EYWAQL$AAAAAa-NH2 | 488 | | 1918.07 | 951.99 | 1919.08 | 960.04 | 640.37 |
| SP581 | Ac-TF$r8EYWAQL$AAAAAa-NH2 | 489 | | 1815.96 | 929.85 | 1816.97 | 908.99 | 606.33 |
| SP582 | Ac-F$r8EYWAQL$AAAAAa-NH2 | 490 | | 1714.91 | 930.92 | 1715.92 | 858.46 | 572.64 |
| SP583 | Ac-LVF$r8EYWAQL$AAAAAa-NH2 | 491 | | 1927.06 | 895.12 | 1928.07 | 964.54 | 643.36 |
| SP584 | Ac-AAF$r8EYWAQL$AAAAAa-NH2 | 492 | | 1856.98 | 859.51 | 1857.99 | 929.5 | 620 |
| SP585 | Ac-LTF$r8EYWAQL$AAAAa-NH2 | 493 | | 1858 | 824.08 | 1859.01 | 930.01 | 620.34 |
| SP586 | Ac-LTF$r8EYWAQL$AAAa-NH2 | 494 | | 1786.97 | 788.56 | 1787.98 | 894.49 | 596.66 |
| SP587 | Ac-LTF$r8EYWAQL$AAa-NH2 | 495 | | 1715.93 | 1138.57 | 1716.94 | 858.97 | 572.98 |
| SP588 | Ac-LTF$r8EYWAQL$Aa-NH2 | 496 | | 1644.89 | 1144.98 | 1645.9 | 823.45 | 549.3 |
| SP589 | Ac-LTF$r8EYWAQL$a-NH2 | 497 | | 1573.85 | 1113.71 | 1574.86 | 787.93 | 525.62 |
| SP590 | Ac-LTF$r8EYWAQL$AAA-OH | 498 | | 1716.91 | 859.55 | 1717.92 | 859.46 | 573.31 |

TABLE 3-continued

| SP | Sequence | SEQ ID NO: | Isomer | Exact Mass | Found Mass | Calc (M + 1)/1 | Calc (M + 2)/2 | Calc (M + 3)/3 |
|---|---|---|---|---|---|---|---|---|
| SP591 | Ac-LTF$r8EYWAQL$A-OH | 499 | | 1574.84 | 975.14 | 1575.85 | 788.43 | 525.95 |
| SP592 | Ac-LTF$r8EYWAQL$AAA-NH2 | 500 | | 1715.93 | 904.75 | 1716.94 | 858.97 | 572.98 |
| SP593 | Ac-LTF$r8EYWAQCba$SAA-OH | 501 | | 1744.91 | 802.49 | 1745.92 | 873.46 | 582.64 |
| SP594 | Ac-LTF$r8EYWAQCba$S-OH | 502 | | 1602.83 | 913.53 | 1603.84 | 802.42 | 535.28 |
| SP595 | Ac-LTF$r8EYWAQCba$S-NH2 | 503 | | 1601.85 | 979.58 | 1602.86 | 801.93 | 534.96 |
| SP596 | 4-FBzl-LTF$r8EYWAQL$AAAAAa-NH2 | 504 | | 2009.05 | 970.52 | 2010.06 | 1005.53 | 670.69 |
| SP597 | 4-FBzl-LTF$r8EYWAQCba$SAA-NH2 | 505 | | 1823.93 | 965.8 | 1824.94 | 912.97 | 608.98 |
| SP598 | Ac-LTF$r8RYWAQL$AAAAAa-NH2 | 506 | | 1956.1 | 988.28 | 1957.11 | 979.06 | 653.04 |
| SP599 | Ac-LTF$r8HYWAQL$AAAAAa-NH2 | 507 | | 1937.06 | 1003.54 | 1938.07 | 969.54 | 646.69 |
| SP600 | Ac-LTF$r8QYWAQL$AAAAAa-NH2 | 508 | | 1928.06 | 993.92 | 1929.07 | 965.04 | 643.69 |
| SP601 | Ac-LTF$r8CitYWAQL$AAAAAa-NH2 | 509 | | 1957.08 | 987 | 1958.09 | 979.55 | 653.37 |
| SP602 | Ac-LTF$r8GlaYWAQL$AAAAAa-NH2 | 510 | | 1973.03 | 983 | 1974.04 | 987.52 | 658.68 |
| SP603 | Ac-LTF$r8F4gYWAQL$AAAAAa-NH2 | 511 | | 2004.1 | 937.86 | 2005.11 | 1003.06 | 669.04 |
| SP604 | Ac-LTF$r82mRYWAQL$AAAAAa-NH2 | 512 | | 1984.13 | 958.58 | 1985.14 | 993.07 | 662.38 |
| SP605 | Ac-LTF$r8ipKYWAQL$AAAAAa-NH2 | 513 | | 1970.14 | 944.52 | 1971.15 | 986.08 | 657.72 |
| SP606 | Ac-LTF$r8F4NH2YWAQL$AAAAAa-NH2 | 514 | | 1962.08 | 946 | 1963.09 | 982.05 | 655.03 |
| SP607 | Ac-LTF$r8EYWAAL$AAAAAa-NH2 | 515 | | 1872.02 | 959.32 | 1873.03 | 937.02 | 625.01 |
| SP608 | Ac-LTF$r8EYWALL$AAAAAa-NH2 | 516 | | 1914.07 | 980.88 | 1915.08 | 958.04 | 639.05 |
| SP609 | Ac-LTF$r8EYWAAibL$AAAAAa-NH2 | 517 | | 1886.03 | 970.61 | 1887.04 | 944.02 | 629.68 |
| SP610 | Ac-LTF$r8EYWASL$AAAAAa-NH2 | 518 | | 1888.01 | 980.51 | 1889.02 | 945.01 | 630.34 |
| SP611 | Ac-LTF$r8EYWANL$AAAAAa-NH2 | 519 | | 1915.02 | 1006.41 | 1916.03 | 958.52 | 639.35 |
| SP612 | Ac-LTF$r8EYWACitL$AAAAAa-NH2 | 520 | | 1958.07 | | 1959.08 | 980.04 | 653.7 |
| SP613 | Ac-LTF$r8EYWAHL$AAAAAa-NH2 | 521 | | 1938.04 | 966.24 | 1939.05 | 970.03 | 647.02 |
| SP614 | Ac-LTF$r8EYWARL$AAAAAa-NH2 | 522 | | 1957.08 | | 1958.09 | 979.55 | 653.37 |
| SP615 | Ac-LTF$r8EpYWAQL$AAAAAa-NH2 | 523 | | 2009.01 | | 2010.02 | 1005.51 | 670.68 |
| SP616 | Cbm-LTF$r8EYWAQCba$SAA-NH2 | 524 | | 1590.85 | | 1591.86 | 796.43 | 531.29 |
| SP617 | Cbm-LTF$r8EYWAQL$AAAAAa-NH2 | 525 | | 1930.04 | | 1931.05 | 966.03 | 644.35 |
| SP618 | Ac-LTF$r8EYWAQL$SAAAAa-NH2 | 526 | | 1945.04 | 1005.11 | 1946.05 | 973.53 | 649.35 |
| SP619 | Ac-LTF$r8EYWAQL$AAAASa-NH2 | 527 | | 1945.04 | 986.52 | 1946.05 | 973.53 | 649.35 |
| SP620 | Ac-LTF$r8EYWAQL$SAAASa-NH2 | 528 | | 1961.03 | 993.27 | 1962.04 | 981.52 | 654.68 |
| SP621 | Ac-LTF$r8EYWAQTba$AAAAAa-NH2 | 529 | | 1943.06 | 983.1 | 1944.07 | 972.54 | 648.69 |
| SP622 | Ac-LTF$r8EYWAQAdm$AAAAAa-NH2 | 530 | | 2007.09 | 990.31 | 2008.1 | 1004.55 | 670.04 |
| SP623 | Ac-LTF$r8EYWAQCha$AAAAAa-NH2 | 531 | | 1969.07 | 987.17 | 1970.08 | 985.54 | 657.36 |
| SP624 | Ac-LTF$r8EYWAQhCha$AAAAAa-NH2 | 532 | | 1983.09 | 1026.11 | 1984.1 | 992.55 | 662.04 |
| SP625 | Ac-LTF$r8EYWAQF$AAAAAa-NH2 | 533 | | 1963.02 | 957.01 | 1964.03 | 982.52 | 655.35 |
| SP626 | Ac-LTF$r8EYWAQhF$AAAAAa-NH2 | 534 | | 1977.04 | 1087.81 | 1978.05 | 989.53 | 660.02 |
| SP627 | Ac-LTF$r8EYWAQL$AANleAAa-NH2 | 535 | | 1971.09 | 933.45 | 1972.1 | 986.55 | 658.04 |
| SP628 | Ac-LTF$r8EYWAQAdm$AANleAAa-NH2 | 536 | | 2049.13 | 1017.97 | 2050.14 | 1025.57 | 684.05 |
| SP629 | 4-FBz-BaLTF$r8EYWAQL$AAAAAa-NH2 | 537 | | 2080.08 | | 2081.09 | 1041.05 | 694.37 |
| SP630 | 4-FBz-BaLTF$r8EYWAQCba$SAA-NH2 | 538 | | 1894.97 | | 1895.98 | 948.49 | 632.66 |
| SP631 | Ac-LTF$r5EYWAQL$s8AAAAAa-NH2 | 539 | | 1929.04 | 1072.68 | 1930.05 | 965.53 | 644.02 |
| SP632 | Ac-LTF$r5EYWAQCba$s8SAA-NH2 | 540 | | 1743.92 | 1107.79 | 1744.93 | 872.97 | 582.31 |
| SP633 | Ac-LTF$r8EYWAQL$AAhhLAAa-NH2 | 541 | | 1999.12 | | 2000.13 | 1000.57 | 667.38 |
| SP634 | Ac-LTF$r8EYWAQL$AAAAAAa-NH2 | 542 | | 2071.11 | | 2072.12 | 1036.56 | 691.38 |
| SP635 | Ac-LTF$r8EYWAQL$AAAAAAAa-NH2 | 543 | | 2142.15 | 778.1 | 2143.16 | 1072.08 | 715.06 |
| SP636 | Ac-LTF$r8EYWAQL$AAAAAAAAa-NH2 | 544 | | 2213.19 | 870.53 | 2214.2 | 1107.6 | 738.74 |
| SP637 | Ac-LTA$r8EYAAQCba$SAA-NH2 | 545 | | 1552.85 | | 1553.86 | 777.43 | 518.62 |
| SP638 | Ac-LTA$r8EYAAQL$AAAAAa-NH2 | 546 | | 1737.97 | 779.45 | 1738.98 | 869.99 | 580.33 |
| SP639 | Ac-LTF$r8EPmpWAQL$AAAAAa-NH2 | 547 | | 2007.03 | 779.54 | 2008.04 | 1004.52 | 670.02 |
| SP640 | Ac-LTF$r8EPmpWAQCba$SAA-NH2 | 548 | | 1821.91 | 838.04 | 1822.92 | 911.96 | 608.31 |
| SP641 | Ac-ATF$r8HYWAQL$S-NH2 | 549 | | 1555.82 | 867.83 | 1556.83 | 778.92 | 519.61 |
| SP642 | Ac-LTF$r8HAWAQL$S-NH2 | 550 | | 1505.84 | 877.91 | 1506.85 | 753.93 | 502.95 |
| SP643 | Ac-LTF$r8HYWAQA$S-NH2 | 551 | | 1555.82 | 852.52 | 1556.83 | 778.92 | 519.61 |
| SP644 | Ac-LTF$r8EYWAQCba$SA-NH2 | 552 | | 1672.92 | 887.18 | 1673.9 | 837.45 | 558.64 |
| SP645 | Ac-LTF$r8EYWAQL$SAA-NH2 | 553 | | 1731.92 | 873.32 | 1732.93 | 866.97 | 578.31 |
| SP646 | Ac-LTF$r8HYWAQCba$SAA-NH2 | 554 | | 1751.94 | 873.05 | 1752.95 | 876.98 | 584.99 |
| SP647 | Ac-LTF$r8SYWAQCba$SAA-NH2 | 555 | | 1701.91 | 844.88 | 1702.92 | 851.96 | 568.31 |
| SP648 | Ac-LTF$r8RYWAQCba$SAA-NH2 | 556 | | 1770.98 | 865.58 | 1771.99 | 886.5 | 591.33 |
| SP649 | Ac-LTF$r8KYWAQCba$SAA-NH2 | 557 | | 1742.98 | 936.57 | 1743.99 | 872.5 | 582 |
| SP650 | Ac-LTF$r8QYWAQCba$SAA-NH2 | 558 | | 1742.94 | 930.93 | 1743.95 | 872.48 | 581.99 |
| SP651 | Ac-LTF$r8EYWAACba$SAA-NH2 | 559 | | 1686.9 | 1032.45 | 1687.91 | 844.46 | 563.31 |
| SP652 | Ac-LTF$r8EYWAQCba$AAA-NH2 | 560 | | 1727.93 | 895.46 | 1728.94 | 864.97 | 576.98 |
| SP653 | Ac-LTF$r8EYWAQL$AAAAA-OH | 561 | | 1858.99 | 824.54 | 1860 | 930.5 | 620.67 |
| SP654 | Ac-LTF$r8EYWAQL$AAAA-OH | 562 | | 1787.95 | 894.48 | 1788.96 | 894.98 | 596.99 |
| SP655 | Ac-LTF$r8EYWAQL$AA-OH | 563 | | 1645.88 | 856 | 1646.89 | 823.95 | 549.63 |
| SP656 | Ac-LTF$r8AF4bOH2WAQL$AAAAAa-NH2 | 564 | | | | | | |
| SP657 | Ac-LTF$r8AF4bOH2WAAL$AAAAAa-NH2 | 565 | | | | | | |
| SP658 | Ac-LTF$r8EF4bOH2WAQCba$SAA-NH2 | 566 | | | | | | |
| SP659 | Ac-LTF$r8ApYWAQL$AAAAAa-NH2 | 567 | | | | | | |
| SP660 | Ac-LTF$r8ApYWAAL$AAAAAa-NH2 | 568 | | | | | | |
| SP661 | Ac-LTF$r8EpYWAQCba$S-NH2 | 569 | | | | | | |
| SP662 | Ac-LTF$rda6AYWAQL$da5AAAAAa-NH2 | 570 | | 1974.06 | 934.44 | | | |
| SP663 | Ac-LTF$rda6EYWAQCba$da5SAA-NH2 | 571 | | 1846.95 | 870.52 | | 869.94 | |
| SP664 | Ac-LTF$rda6EYWAQL$da5AAAAAa-NH2 | 572 | | | | | | |
| SP665 | Ac-LTF$ra9EYWAQL$a6AAAAAa-NH2 | 573 | | | 936.57 | | 935.51 | |
| SP666 | Ac-LTF$ra9EYWAQL$a6AAAAAa-NH2 | 574 | | | | | | |

TABLE 3-continued

| SP | Sequence | SEQ ID NO: | Isomer | Exact Mass | Found Mass | Calc (M + 1)/1 | Calc (M + 2)/2 | Calc (M + 3)/3 |
|---|---|---|---|---|---|---|---|---|
| SP667 | Ac-LTF$ra9EYWAQCba$a6SAA-NH2 | 575 | | | | | | |
| SP668 | Ac-LTA$ra9EYWAQCba$a6SAA-NH2 | 576 | | | | | | |
| SP669 | 5-FAM-BaLTF$ra9EYWAQCba$a6SAA-NH2 | 577 | | | | | | |
| SP670 | 5-FAM-BaLTF$r8EYWAQL$AAAAAa-NH2 | 578 | | 2316.11 | | | | |
| SP671 | 5-FAM-BaLTF$/r8EYWAQL$/AAAAAa-NH2 | 579 | | 2344.15 | | | | |
| SP672 | 5-FAM-BaLTA$r8EYWAQL$AAAAAa-NH2 | 580 | | 2240.08 | | | | |
| SP673 | 5-FAM-BaLTF$r8AYWAQL$AAAAAa-NH2 | 581 | | 2258.11 | | | | |
| SP674 | 5-FAM-BaATF$r8EYWAQL$AAAAAa-NH2 | 582 | | 2274.07 | | | | |
| SP675 | 5-FAM-BaLAF$r8EYWAQL$AAAAAa-NH2 | 583 | | 2286.1 | | | | |
| SP676 | 5-FAM-BaLTF$r8EAWAQL$AAAAAa-NH2 | 584 | | 2224.09 | | | | |
| SP677 | 5-FAM-BaLTF$r8EYAAQL$AAAAAa-NH2 | 585 | | 2201.07 | | | | |
| SP678 | 5-FAM-BaLTA$r8EYAAQL$AAAAAa-NH2 | 586 | | 2125.04 | | | | |
| SP679 | 5-FAM-BaLTF$r8EYWAAL$AAAAAa-NH2 | 587 | | 2259.09 | | | | |
| SP680 | 5-FAM-BaLTF$r8EYWAQA$AAAAAa-NH2 | 588 | | 2274.07 | | | | |
| SP681 | 5-FAM-BaLTF$/r8EYWAQCba$/SAA-NH2 | 589 | | 2159.03 | | | | |
| SP682 | 5-FAM-BaLTA$r8EYWAQCba$SAA-NH2 | 590 | | 2054.97 | | | | |
| SP683 | 5-FAM-BaLTF$r8EYAAQCba$SAA-NH2 | 591 | | 2015.96 | | | | |
| SP684 | 5-FAM-BaLTA$r8EYAAQCba$SAA-NH2 | 592 | | 1939.92 | | | | |
| SP685 | 5-FAM-BaQSQQTF$r8NLWRLL$QN-NH2 | 593 | | 2495.23 | | | | |
| SP686 | 5-TAMRA-BaLTF$r8EYWAQCba$SAA-NH2 | 594 | | 2186.1 | | | | |
| SP687 | 5-TAMRA-BaLTA$r8EYWAQCba$SAA-NH2 | 595 | | 2110.07 | | | | |
| SP688 | 5-TAMRA-BaLTF$r8EYAAQCba$SAA-NH2 | 596 | | 2071.06 | | | | |
| SP689 | 5-TAMRA-BaLTA$r8EYAAQCba$SAA-NH2 | 597 | | 1995.03 | | | | |
| SP690 | 5-TAMRA-BaLTF$/r8EYWAQCba$/SAA-NH2 | 598 | | 2214.13 | | | | |
| SP691 | 5-TAMRA-BaLTF$r8EYWAQL$AAAAAa-NH2 | 599 | | 2371.22 | | | | |
| SP692 | 5-TAMRA-BaLTA$r8EYWAQL$AAAAAa-NH2 | 600 | | 2295.19 | | | | |
| SP693 | 5-TAMRA-BaLTF$/r8EYWAQL$/AAAAAa-NH2 | 601 | | 2399.25 | | | | |
| SP694 | Ac-LTF$r8EYWCou7QCba$SAA-OH | 602 | | 1947.93 | | | | |
| SP695 | Ac-LTF$r8EYWCou7QCba$S-OH | 603 | | 1805.86 | | | | |
| SP696 | Ac-LTA$r8EYWCou7QCba$SAA-NH2 | 604 | | 1870.91 | | | | |
| SP697 | Ac-LTF$r8EYACou7QCba$SAA-NH2 | 605 | | 1831.9 | | | | |
| SP698 | Ac-LTA$r8EYACou7QCba$SAA-NH2 | 606 | | 1755.87 | | | | |
| SP699 | Ac-LTF$/r8EYWCou7QCba$/SAA-NH2 | 607 | | 1974.98 | | | | |
| SP700 | Ac-LTF$r8EYWCou7QL$AAAAAa-NH2 | 608 | | 2132.06 | | | | |
| SP701 | Ac-LTF$/r8EYWCou7QL$/AAAAAa-NH2 | 609 | | 2160.09 | | | | |
| SP702 | Ac-LTF$r8EYWCou7QL$AAAAA-OH | 610 | | 2062.01 | | | | |
| SP703 | Ac-LTF$r8EYWCou7QL$AAAA-OH | 611 | | 1990.97 | | | | |
| SP704 | Ac-LTF$r8EYWCou7QL$AAA-OH | 612 | | 1919.94 | | | | |
| SP705 | Ac-LTF$r8EYWCou7QL$AA-OH | 613 | | 1848.9 | | | | |
| SP706 | Ac-LTF$r8EYWCou7QL$A-OH | 614 | | 1777.86 | | | | |
| SP707 | Ac-LTF$r8EYWAQL$AAAASa-NH2 | 615 | iso2 | | 974.4 | | 973.53 | |
| SP708 | Ac-LTF$r8AYWAAL$AAAAAa-NH2 | 616 | iso2 | 1814.01 | 908.82 | 1815.02 | 908.01 | 605.68 |
| SP709 | Biotin-BaLTF$r8EYWAQL$AAAAAa-NH2 | 617 | | 2184.14 | 1093.64 | 2185.15 | 1093.08 | 729.05 |
| SP710 | Ac-LTF$r8HAWAQL$S-NH2 | 618 | iso2 | 1505.84 | 754.43 | 1506.85 | 753.93 | 502.95 |
| SP711 | Ac-LTF$r8EYWAQCba$SA-NH2 | 619 | iso2 | 1672.89 | 838.05 | 1673.9 | 837.45 | 558.64 |
| SP712 | Ac-LTF$r8HYWAQCba$SAA-NH2 | 620 | iso2 | 1751.94 | 877.55 | 1752.95 | 876.98 | 584.99 |
| SP713 | Ac-LTF$r8SYWAQCba$SAA-NH2 | 621 | iso2 | 1701.91 | 852.48 | 1702.92 | 851.96 | 568.31 |
| SP714 | Ac-LTF$r8RYWAQCba$SAA-NH2 | 622 | iso2 | 1770.98 | 887.45 | 1771.99 | 886.5 | 591.33 |
| SP715 | Ac-LTF$r8KYWAQCba$SAA-NH2 | 623 | iso2 | 1742.98 | 872.92 | 1743.99 | 872.5 | 582 |
| SP716 | Ac-LTF$r8EYWAQCba$AAA-NH2 | 624 | iso2 | 1727.93 | 865.71 | 1728.94 | 864.97 | 576.98 |
| SP717 | Ac-LTF$r8EYWAQL$AAAAAaBaC-NH2 | 625 | | 2103.09 | 1053.12 | 2104.1 | 1052.55 | 702.04 |
| SP718 | Ac-LTF$r8EYWAQL$AAAAAdPeg4C-NH2 | 626 | | 2279.19 | 1141.46 | 2280.2 | 1140.6 | 760.74 |
| SP719 | Ac-LTA$r8AYWAAL$AAAAAa-NH2 | 627 | | 1737.98 | 870.43 | 1738.99 | 870 | 580.33 |
| SP720 | Ac-LTF$r8AYAAAL$AAAAAa-NH2 | 628 | | 1698.97 | 851 | 1699.98 | 850.49 | 567.33 |
| SP721 | 5-FAM-BaLTF$r8AYWAAL$AAAAAa-NH2 | 629 | | 2201.09 | 1101.87 | 2202.1 | 1101.55 | 734.7 |
| SP722 | Ac-LTA$r8AYWAQL$AAAAAa-NH2 | 630 | | 1795 | 898.92 | 1796.01 | 898.51 | 599.34 |
| SP723 | Ac-LTF$r8AYAAQL$AAAAAa-NH2 | 631 | | 1755.99 | 879.49 | 1757 | 879 | 586.34 |
| SP724 | Ac-LTF$rda6AYWAAL$da5AAAAAa-NH2 | 632 | | 1807.97 | | 1808.98 | 904.99 | 603.66 |
| SP725 | FITC-BaLTF$r8AYWAQL$AAAAAa-NH2 | 633 | | 2347.1 | 1174.49 | 2348.11 | 1174.56 | 783.37 |
| SP726 | FITC-BaLTF$r8EYWAQCba$SAA-NH2 | 634 | | 2161.99 | 1082.35 | 2163 | 1082 | 721.67 |
| SP733 | Ac-LTF$r8EYWAQL$EAAAAa-NH2 | 635 | | 1987.05 | 995.03 | 1988.06 | 994.53 | 663.36 |
| SP734 | Ac-LTF$r8AYWAQL$EAAAAa-NH2 | 636 | | 1929.04 | 966.35 | 1930.05 | 965.53 | 644.02 |
| SP735 | Ac-LTF$r8EYWAQL$AAAAAaBaKbio-NH2 | 637 | | 2354.25 | 1178.47 | 2355.26 | 1178.13 | 785.76 |
| SP736 | Ac-LTF$r8AYWAAL$AAAAAa-NH2 | 638 | | 1814.01 | 908.45 | 1815.02 | 908.01 | 605.68 |
| SP737 | Ac-LTF$r8AYAAAL$AAAAAa-NH2 | 639 | iso2 | 1698.97 | 850.91 | 1699.98 | 850.49 | 567.33 |
| SP738 | Ac-LTF$r8AYAAQL$AAAAAa-NH2 | 640 | iso2 | 1755.99 | 879.4 | 1757 | 879 | 586.34 |
| SP739 | Ac-LTF$r8EYWAQL$EAAAAa-NH2 | 641 | iso2 | 1987.05 | 995.21 | 1988.06 | 994.53 | 663.36 |
| SP740 | Ac-LTF$r8AYWAQL$EAAAAa-NH2 | 642 | iso2 | 1929.04 | 966.08 | 1930.05 | 965.53 | 644.02 |
| SP741 | Ac-LTF$r8EYWAQCba$SAAAAa-NH2 | 643 | | 1957.04 | 980.04 | 1958.05 | 979.53 | 653.35 |
| SP742 | Ac-LTF$r8EYWAQLStAAA$r5AA-NH2 | 644 | | 2023.12 | 1012.83 | 2024.13 | 1012.57 | 675.38 |
| SP743 | Ac-LTF$r8EYWAQL$A$AAA$A-NH2 | 645 | | 2108.17 | 1055.44 | 2109.18 | 1055.09 | 703.73 |
| SP744 | Ac-LTF$r8EYWAQL$AA$AAA$A-NH2 | 646 | | 2179.21 | 1090.77 | 2180.22 | 1090.61 | 727.41 |
| SP745 | Ac-LTF$r8EYWAQL$AAA$AAA$A-NH2 | 647 | | 2250.25 | 1126.69 | 2251.26 | 1126.13 | 751.09 |
| SP746 | Ac-AAALTF$r8EYWAQL$AAA-OH | 648 | | 1930.02 | | 1931.03 | 966.02 | 644.35 |
| SP747 | Ac-AAALTF$r8EYWAQL$AAA-NH2 | 649 | | 1929.04 | 965.85 | 1930.05 | 965.53 | 644.02 |
| SP748 | Ac-AAAALTF$r8EYWAQL$AAA-NH2 | 650 | | 2000.08 | 1001.4 | 2001.09 | 1001.05 | 667.7 |

TABLE 3-continued

| SP | Sequence | SEQ ID NO: | Isomer | Exact Mass | Found Mass | Calc (M + 1)/1 | Calc (M + 2)/2 | Calc (M + 3)/3 |
|---|---|---|---|---|---|---|---|---|
| SP749 | Ac-AAAAALTF$r8EYWAQL$AAA-NH2 | 651 | | 2071.11 | 1037.13 | 2072.12 | 1036.56 | 691.38 |
| SP750 | Ac-AAAAAALTF$r8EYWAQL$AAA-NH2 | 652 | | 2142.15 | | 2143.16 | 1072.08 | 715.06 |
| SP751 | Ac-LTF$rda6EYWAQCba$da6SAA-NH2 | 653 | iso2 | 1751.89 | 877.36 | 1752.9 | 876.95 | 584.97 |
| SP752 | Ac-t$r5wya$r5f4CF3ekllr-NH2 | 654 | | | 844.25 | | | |
| SP753 | Ac-tawy$r5nf4CF3e$r5llr-NH2 | 655 | | | 837.03 | | | |
| SP754 | Ac-tawy$r5f4CF3ek$r5lr-NH2 | 656 | | | 822.97 | | | |
| SP755 | Ac-tawyanf4CF3e$r5llr$r5a-NH2 | 657 | | | 908.35 | | | |
| SP756 | Ac-t$s8wyanf4CF3e$r5llr-NH2 | 658 | | | 858.03 | | | |
| SP757 | Ac-tawy$s8nf4CF3ekll$r5a-NH2 | 659 | | | 879.86 | | | |
| SP758 | Ac-tawy$s8f4CF3ekllr$r5a-NH2 | 660 | | | 936.38 | | | |
| SP759 | Ac-tawy$s8naekll$r5a-NH2 | 661 | | | 844.25 | | | |
| SP760 | 5-FAM-Batawy$s8nf4CF3ekll$r5a-NH2 | 662 | | | | | | |
| SP761 | 5-FAM-Batawy$s8naekll$r5a-NH2 | 663 | | | | | | |
| SP762 | Ac-tawy$s8nf4CF3eall$r5a-NH2 | 664 | | | | | | |
| SP763 | Ac-tawy$s8nf4CF3ekll$r5aaaaa-NH2 | 665 | | | | | | |
| SP764 | Ac-tawy$s8nf4CF3eall$r5aaaaa-NH2 | 666 | | | | | | |

Table 3a shows a selection of peptidomimetic macrocycles.

TABLE 3a

| SP | Sequence | SEQ ID NO: | Isomer | Exact Mass | Found Mass | Calc (M + 1)/1 | Calc (M + 2)/2 | Calc (M + 3)/3 |
|---|---|---|---|---|---|---|---|---|
| SP244 | Ac-LTF$r8EF4coohWAQCba$SANleA-NH2 | 667 | | 1885 | 943.59 | 1886.01 | 943.51 | 629.34 |
| SP331 | Ac-LTF$r8EYWAQL$AAAAAa-NH2 | 668 | iso2 | 1929.04 | 966.08 | 1930.05 | 965.53 | 644.02 |
| SP555 | Ac-LTF$r8EY6clWAQL$AAAAAa-NH2 | 669 | | 1963 | 983.28 | 1964.01 | 982.51 | 655.34 |
| SP557 | Ac-AAALTF$r8EYWAQL$AAAAAa-NH2 | 670 | | 2142.15 | 1072.83 | 2143.16 | 1072.08 | 715.06 |
| SP558 | Ac-LTF34F2$r8EYWAQL$AAAAAa-NH2 | 671 | | 1965.02 | 984.3 | 1966.03 | 983.52 | 656.01 |
| SP562 | Ac-LTF$r8EYWAQL$AAibAAAa-NH2 | 672 | | 1943.06 | 973.11 | 1944.07 | 972.54 | 648.69 |
| SP564 | Ac-LTF$r8EYWAQL$AAAAibAa-NH2 | 673 | | 1943.06 | 973.48 | 1944.07 | 972.54 | 648.69 |
| SP566 | Ac-LTF$r8EYWAQL$AAAAAiba-NH2 | 674 | iso2 | 1943.06 | 973.38 | 1944.07 | 972.54 | 648.69 |
| SP567 | Ac-LTF$r8EYWAQL$AAAAAAib-NH2 | 675 | | 1943.06 | 973.01 | 1944.07 | 972.54 | 648.69 |
| SP572 | Ac-LTF$r8EYWAQL$AAAAAaa-NH2 | 676 | | 1929.04 | 966.35 | 1930.05 | 965.53 | 644.02 |
| SP573 | Ac-LTF$r8EYWAQL$AAAAAAA-NH2 | 677 | | 1929.04 | 966.35 | 1930.05 | 965.53 | 644.02 |
| SP578 | Ac-LTF$r8EYWAQL$AAAAASar-NH2 | 678 | | 1929.04 | 966.08 | 1930.05 | 965.53 | 644.02 |
| SP551 | Ac-LTF$r8EYWAQL$AAAAAa-OH | 679 | iso2 | 1930.02 | 965.89 | 1931.03 | 966.02 | 644.35 |
| SP662 | Ac-LTF$rda6AYWAQL$da5AAAAAa-NH2 | 680 | | 1974.06 | 934.44 | | 933.49 | |
| SP367 | 5-FAM-BaLTF$r8EYWAQCba$SAA-NH2 | 681 | | 2131 | 1067.09 | 2132.01 | 1066.51 | 711.34 |
| SP349 | Ac-LTF$r8EF4coohWAQCba$AAAAAa-NH2 | 682 | iso2 | 1969.04 | 986.06 | 1970.05 | 985.53 | 657.35 |
| SP347 | Ac-LTF$r8EYWAQCba$AAAAAa-NH2 | 683 | iso2 | 1941.04 | 972.55 | 1942.05 | 971.53 | 648.02 |

Table 3b shows a further selection of peptidomimetic macrocycles.

TABLE 3b

Table 3b shows a further selection of peptidomimetic macrocycles.

| SP | Sequence | SEQ ID NO: | Isomer | Exact Mass | Found Mass | Calc (M + 1)/1 | Calc (M + 2)/2 | Calc (M + 3)/3 |
|---|---|---|---|---|---|---|---|---|
| SP581 | Ac-TF$r8EYWAQL$AAAAAa-NH2 | 684 | | 1815.96 | 929.85 | 1816.97 | 908.99 | 606.33 |
| SP582 | Ac-F$r8EYWAQL$AAAAAa-NH2 | 685 | | 1714.91 | 930.92 | 1715.92 | 858.46 | 572.64 |
| SP583 | Ac-LVF$r8EYWAQL$AAAAAa-NH2 | 686 | | 1927.06 | 895.12 | 1928.07 | 964.54 | 643.36 |
| SP584 | Ac-AAF$r8EYWAQL$AAAAAa-NH2 | 687 | | 1856.98 | 859.51 | 1857.99 | 929.5 | 620 |
| SP585 | Ac-LTF$r8EYWAQL$AAAAa-NH2 | 688 | | 1858 | 824.08 | 1859.01 | 930.01 | 620.34 |
| SP586 | Ac-LTF$r8EYWAQL$AAAa-NH2 | 689 | | 1786.92 | 788.56 | 1787.98 | 894.49 | 596.66 |
| SP587 | Ac-LTF$r8EYWAQL$AAa-NH2 | 690 | | 1715.93 | 1138.57 | 1716.94 | 858.97 | 572.98 |
| SP588 | Ac-LTF$r8EYWAQL$Aa-NH2 | 691 | | 1644.89 | 1144.98 | 1645.9 | 823.45 | 549.3 |
| SP589 | Ac-LTF$r8EYWAQL$a-NH2 | 692 | | 1573.85 | 1113.71 | 1574.86 | 787.93 | 525.62 |

In the sequences shown above and elsewhere, the following abbreviations are used: "Nle" represents norleucine, "Aib" represents 2-aminoisobutyric acid, "Ac" represents acetyl, and "Pr" represents propionyl. Amino acids represented as "$" are alpha-Me S5-pentenyl-alanine olefin amino acids connected by an all-carbon crosslinker comprising one double bond. Amino acids represented as "$r5" are alpha-Me R5-pentenyl-alanine olefin amino acids connected by an all-carbon comprising one double bond. Amino acids represented as "$s8" are alpha-Me S8-octenyl-alanine olefin amino acids connected by an all-carbon crosslinker comprising one double bond. Amino acids represented as "$r8" are alpha-Me R8-octenyl-alanine olefin amino acids connected by an all-carbon crosslinker comprising one double bond. "Ahx" represents an aminocyclohexyl linker. The crosslinkers are linear all-carbon crosslinker comprising eight or eleven carbon atoms between the alpha carbons of each amino acid. Amino acids represented as "$/" are alpha-Me S5-pentenyl-alanine olefin amino acids that are not connected by any crosslinker. Amino acids represented as "$/r5" are alpha-Me R5-pentenyl-alanine olefin amino acids that are not connected by any crosslinker. Amino acids represented as "$/s8" are alpha-Me S8-octenyl-alanine olefin amino acids that are not connected by any crosslinker. Amino acids represented as "$/r8" are alpha-Me R8-octenyl-alanine olefin amino acids that are not connected by any crosslinker. Amino acids represented as "Amw" are alpha-Me tryptophan amino acids. Amino acids represented as "Aml" are alpha-Me leucine amino acids. Amino acids represented as "Amf" are alpha-Me phenylalanine amino acids. Amino acids represented as "2ff" are 2-fluoro-phenylalanine amino acids. Amino acids represented as "3ff" are 3-fluoro-phenylalanine amino acids. Amino acids represented as "St" are amino acids comprising two pentenyl-alanine olefin side chains, each of which is crosslinked to another amino acid as indicated. Amino acids represented as "St//" are amino acids comprising two pentenyl-alanine olefin side chains that are not crosslinked. Amino acids represented as "% St" are amino acids comprising two pentenyl-alanine olefin side chains, each of which is crosslinked to another amino acid as indicated via fully saturated hydrocarbon crosslinks. Amino acids represented as "Ba" are beta-alanine. The lower-case character "e" or "z" within the designation of a crosslinked amino acid (e.g. "$er8" or "$zr8") represents the configuration of the double bond (E or Z, respectively). In other contexts, lower-case letters such as "a" or "f" represent D amino acids (e.g. D-alanine, or D-phenylalanine, respectively). Amino acids designated as "NmW" represent N-methyltryptophan. Amino acids designated as "NmY" represent N-methyltyrosine. Amino acids designated as "NmA" represent N-methylalanine. "Kbio" represents a biotin group attached to the side chain amino group of a lysine residue. Amino acids designated as "Sar" represent sarcosine. Amino acids designated as "Cha" represent cyclohexyl alanine. Amino acids designated as "Cpg" represent cyclopentyl glycine. Amino acids designated as "Chg" represent cyclohexyl glycine. Amino acids designated as "Cba" represent cyclobutyl alanine. Amino acids designated as "F4I" represent 4-iodo phenylalanine. "7L" represents N15 isotopic leucine. Amino acids designated as "F3Cl" represent 3-chloro phenylalanine. Amino acids designated as "F4cooh" represent 4-carboxy phenylalanine. Amino acids designated as "F34F2" represent 3,4-difluoro phenylalanine. Amino acids designated as "6clW" represent 6-chloro tryptophan. Amino acids designated as "$rda6" represent alpha-Me R6-hexynyl-alanine alkynyl amino acids, crosslinked via a dialkyne bond to a second alkynyl amino acid. Amino acids designated as "$da5" represent alpha-Me S5-pentynyl-alanine alkynyl amino acids, wherein the alkyne forms one half of a dialkyne bond with a second alkynyl amino acid. Amino acids designated as "$ra9" represent alpha-Me R9-nonynyl-alanine alkynyl amino acids, crosslinked via an alkyne metathesis reaction with a second alkynyl amino acid. Amino acids designated as "$a6" represent alpha-Me S6-hexynyl-alanine alkynyl amino acids, crosslinked via an alkyne metathesis reaction with a second alkynyl amino acid. The designation "iso1" or "iso2" indicates that the peptidomimetic macrocycle is a single isomer.

Amino acids designated as "Cit" represent citrulline. Amino acids designated as "Cou4", "Cou6", "Cou7" and "Cou8", respectively, represent the following structures:

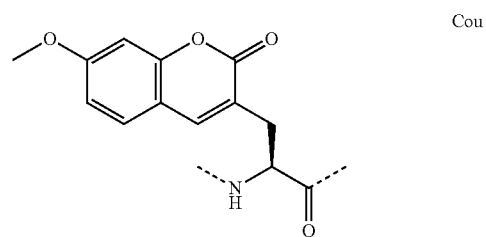

Cou

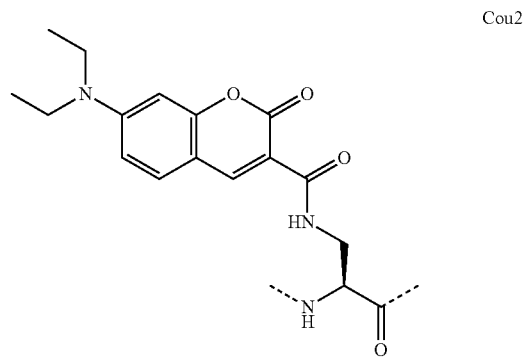

Cou2

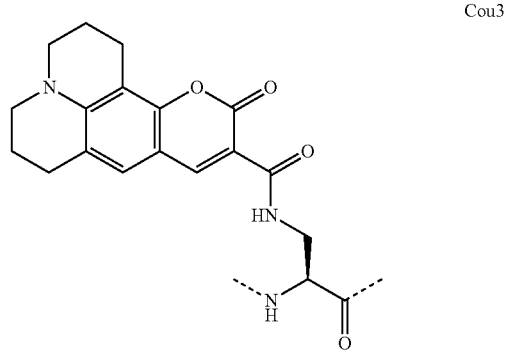

Cou3

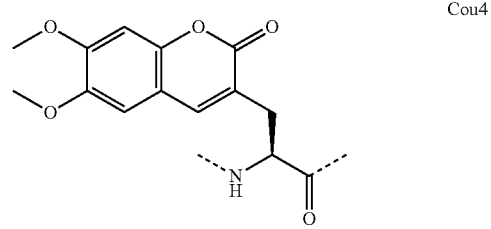

Cou4

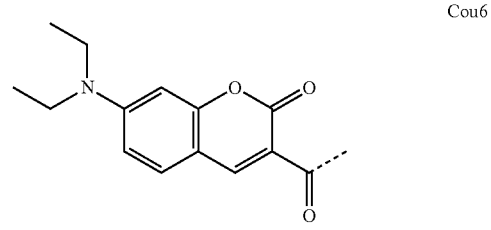

Cou6

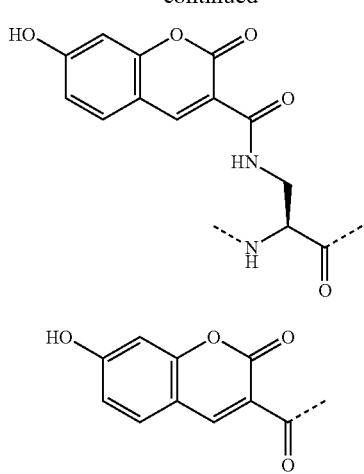

Cou7

Cou8

In some embodiments, a peptidomimetic macrocycle is obtained in more than one isomer, for example due to the configuration of a double bond within the structure of the crosslinker (E vs Z). In some embodiments, such isomers can or cannot be separated by conventional chromatographic methods. In some embodiments, one isomer has improved biological properties relative to the other isomer. In one embodiment, an E crosslinker olefin isomer of a peptidomimetic macrocycle has better solubility, better target affinity, better in vivo or in vitro efficacy, higher helicity, or improved cell permeability relative to its Z counterpart. In another embodiment, a Z crosslinker olefin isomer of a peptidomimetic macrocycle has better solubility, better target affinity, better in vivo or in vitro efficacy, higher helicity, or improved cell permeability relative to its E counterpart.

Table 3c shows exempla peptidomimetic macrocycles:

TABLE 3c
| Structure | SEQ ID NO: |
|---|---|
| 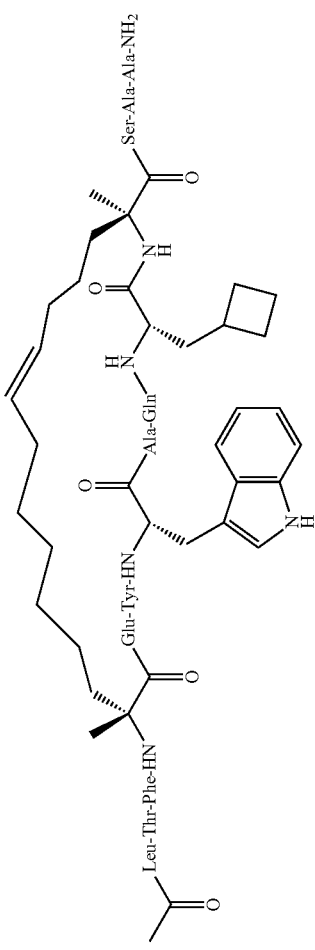 Chemical Formula: $C_{87}H_{125}N_{17}O_{21}$<br>Exact Mass: 1743.92<br>Molecular Weight: 1745.02<br>Ac-LTF$er8EYWAQCba$eSAA-NH2 | 163 |
| 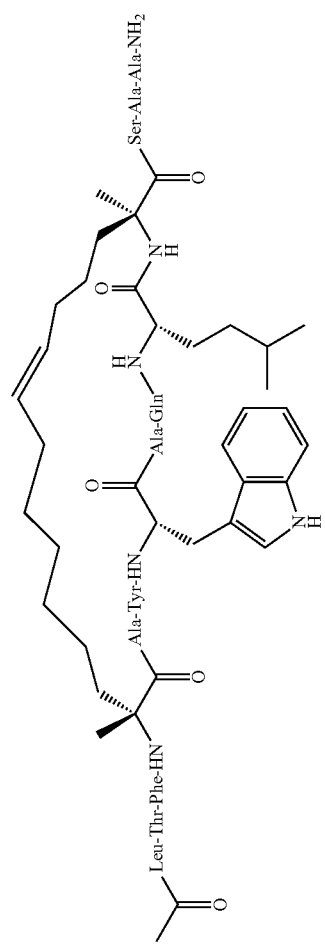 Chemical Formula: $C_{85}H_{125}N_{17}O_{19}$<br>Exact Mass: 1687.93<br>Molecular Weight: 1689.00<br>Ac-LTF$er8AYWAQhL$eSAA-NH2 | 124 |

TABLE 3c-continued
| Structure | SEQ ID NO: |
|---|---|
| 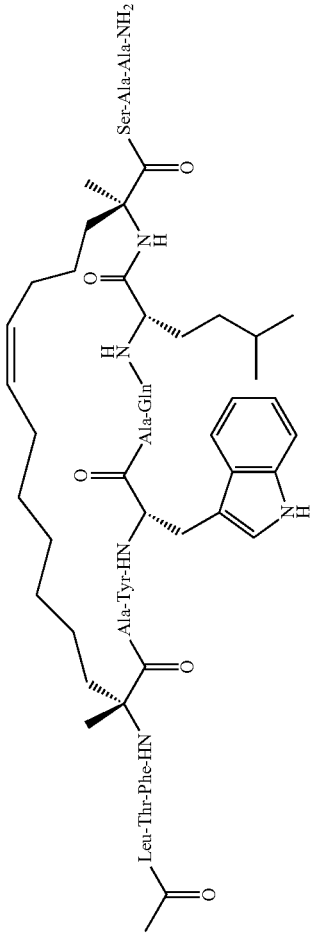 Chemical Formula: $C_{85}H_{125}N_{17}O_{19}$<br>Exact Mass: 1687.93<br>Molecular Weight: 1689.00<br>Ac-LTF$zr8AYWAQhLS$zSAA-NH2 | 123 |
| 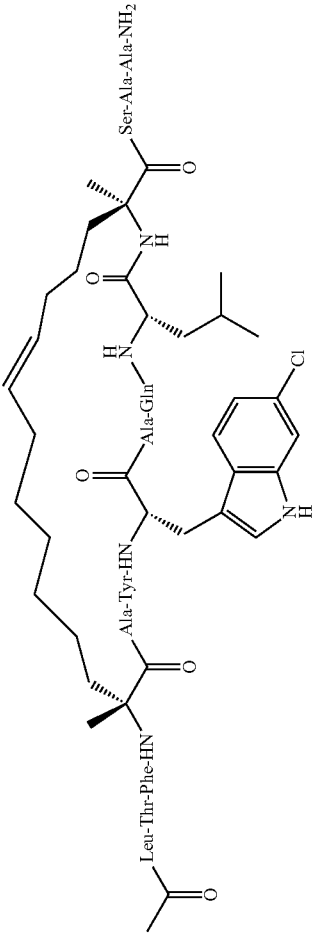 Chemical Formula: $C_{84}H_{122}ClN_{17}O_{19}$<br>Exact Mass: 1707.88<br>Molecular Weight: 1709.42<br>Ac-LTF$er8AY6clWAQLS$eSAA-NH2 | 108 |

TABLE 3c-continued
| Structure | SEQ ID NO: |
|---|---|
| 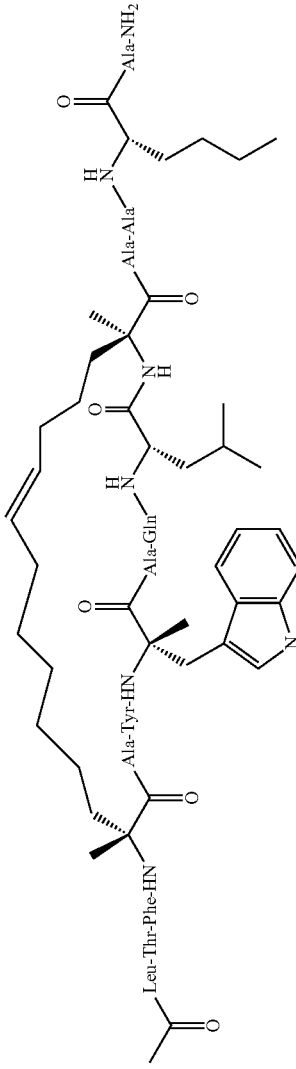 Chemical Formula: C$_{91}$H$_{136}$N$_{18}$O$_{19}$<br>Exact Mass: 1785.02<br>Molecular Weight: 1786.16<br>Ac-LTFSer8AYAmwAQL$eAANleA-NH2 | 397 |
| 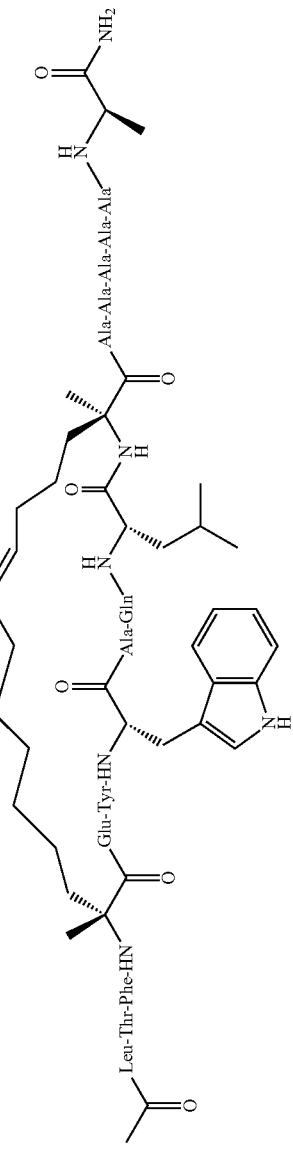 Chemical Formula: C$_{95}$H$_{140}$N$_{20}$O$_{23}$<br>Exact Mass: 1929.04<br>Molecular Weight: 1930.25<br>Ac-LTFSer8EYWAQL$eAAAAAa-NH2 | 340 |

TABLE 3c-continued

| Structure | SEQ ID NO: |
|---|---|
| Chemical Formula: C$_{95}$H$_{142}$N$_{20}$O$_{23}$<br>Exact Mass: 1931.06<br>Molecular Weight: 1932.26<br><br>Ac-LTF%r8EYWAQL%AAAAAa-NH2 | 454 |
| Chemical Formula: C$_{96}$H$_{140}$N$_{20}$O$_{24}$<br>Exact Mass: 1957.03<br>Molecular Weight: 1958.26<br><br>Ac-LTF$Ser8EYWSQCbaSeAAAAAa-NH2 | 360 |

TABLE 3c-continued
| Structure | SEQ ID NO: |
|---|---|
| 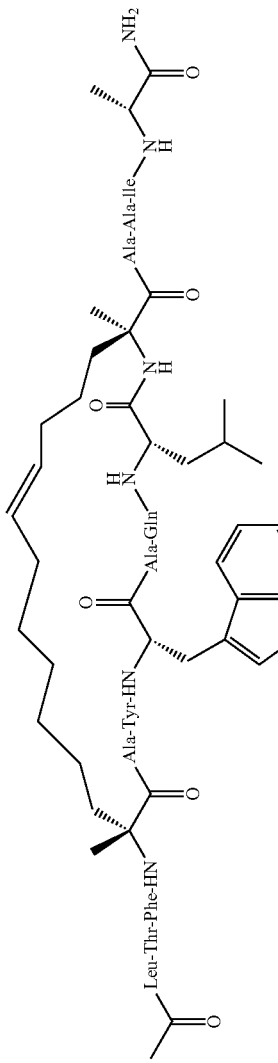Chemical Formula: C₉₀H₁₃₄N₁₈O₁₉<br>Exact Mass: 1771.01<br>Molecular Weight: 1772.14<br>Ac-LTF$AYWAQL$eAAIa-NH2 | 80 |
| 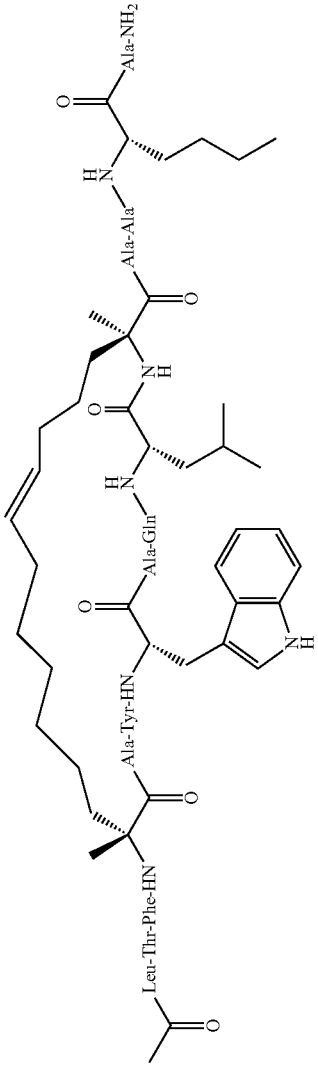Chemical Formula: C₉₀H₁₃₄N₁₈O₁₉<br>Exact Mass: 1771.01<br>Molecular Weight: 1772.14<br>Ac-LTF$er8AYWAQL$eAANleA-NH2 | 78 |

TABLE 3c-continued
| Structure | SEQ ID NO: |
|---|---|
| 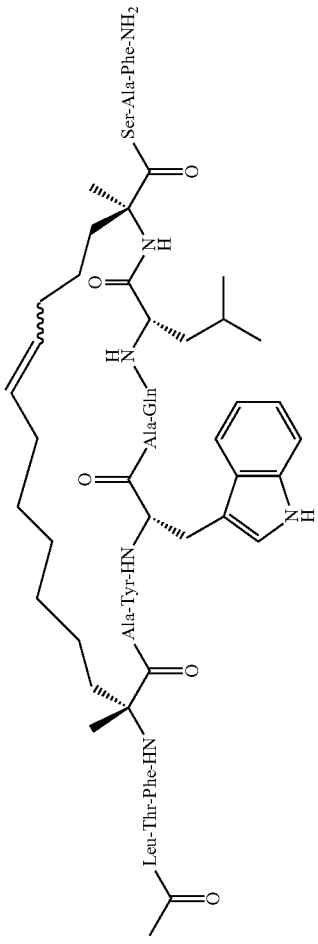 Chemical Formula: $C_{90}H_{127}N_{17}O_{19}$<br>Exact Mass: 1749.95<br>Molecular Weight: 1751.07<br>Ac-LTF8Ser8AYWAQlLSSAF-NH2 | 16 |
| 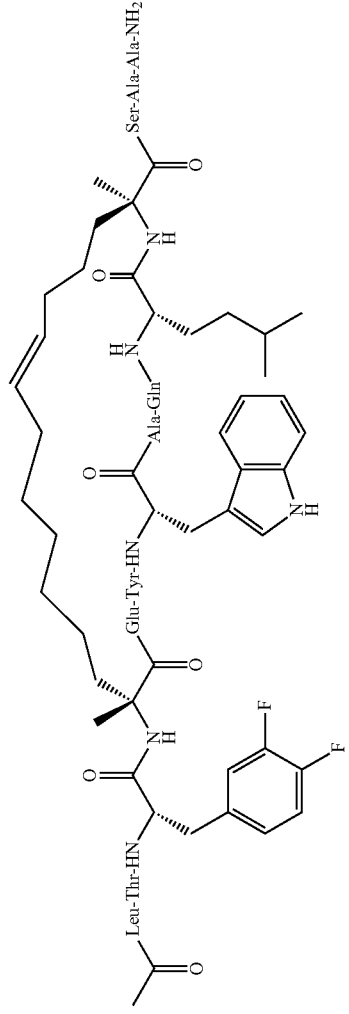 Chemical Formula: $C_{87}H_{125}F_2N_{17}O_{21}$<br>Exact Mass: 1781.92<br>Molecular Weight: 1783.02<br>Ac-LTF34F2Ser8EYWAQhL8eSAA-NH2 | 169 |

TABLE 3c-continued

| Structure | SEQ ID NO: |
|---|---|
| Chemical Formula: C₉₃H₁₃₈N₂₀O₂₁<br>Exact Mass: 1871.03<br>Molecular Weight: 1872.21<br><br>Ac-LTF$Ser8AYWAQL$eAAAAAa-NH2 | 324 |
| Chemical Formula: C₉₄H₁₃₆N₁₈O₂₂<br>Exact Mass: 1869.01<br>Molecular Weight: 1870.19<br><br>Ac-LTF$Ser8EF4coohWAQCbaSeAA-I-a-NH2 | 258 |

TABLE 3c-continued
| Structure | SEQ ID NO: |
|---|---|
| 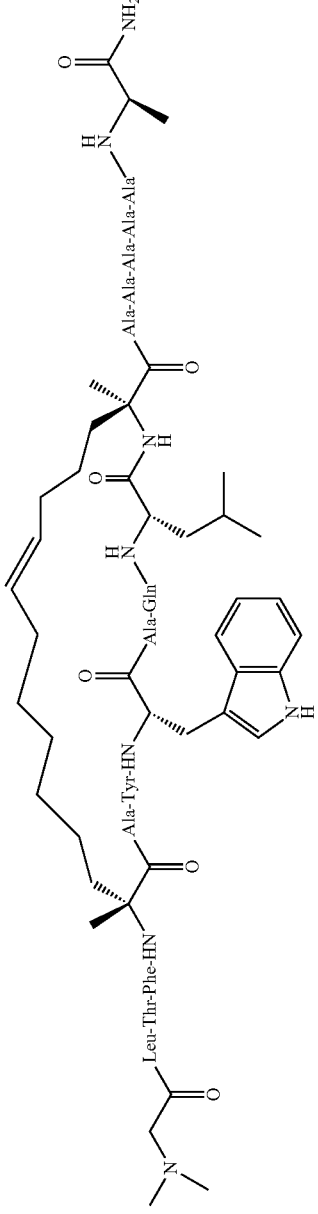 Chemical Formula: C₉₅H₁₄₃N₂₁O₂₁<br>Exact Mass: 1914.08<br>Molecular Weight: 1915.28<br>Dmaac-LTFSer8AYWAQLSeAAAAa-NH2 | 446 |
| 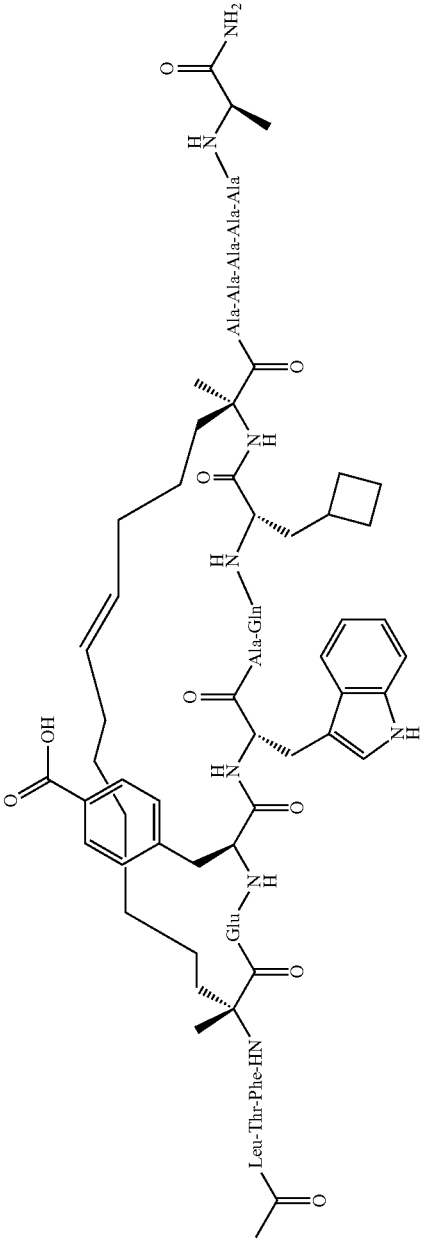 Chemical Formula: C₉₇H₁₄₀N₂₀O₂₄<br>Exact Mass: 1969.03<br>Molecular Weight: 1970.27<br>Ac-LTFSer8EF4coohWAQCbaSeAAAAa-NH2 | 358 |

TABLE 3c-continued
| Structure | SEQ ID NO: |
|---|---|
| 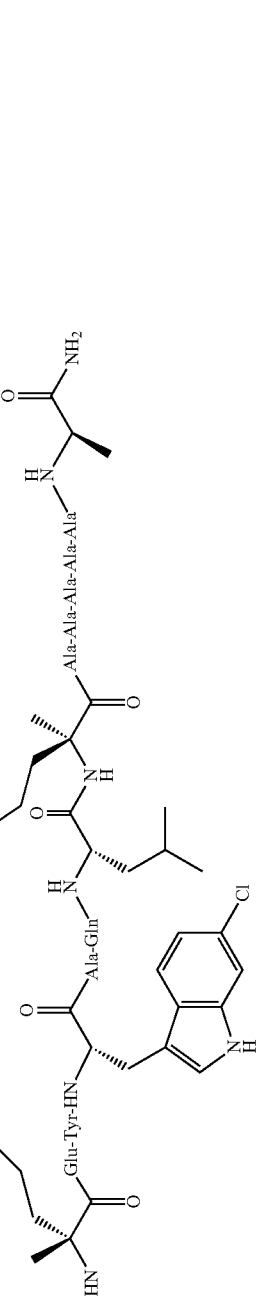 Chemical Formula: $C_{95}H_{139}ClN_{20}O_{23}$<br>Exact Mass: 1963.00<br>Molecular Weight: 1964.69<br><br>Ac-LTF$er8EY6clWAQL$eAAAAa-NH2 | 464 |
| 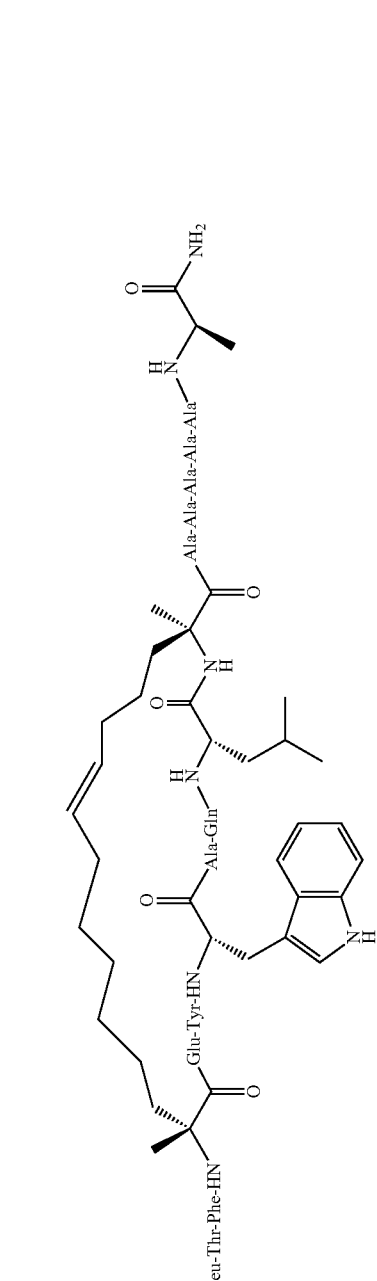 Chemical Formula: $C_{104}H_{155}N_{23}O_{26}$<br>Exact Mass: 2142.15<br>Molecular Weight: 2143.48<br><br>Ac-AAALTF$er8EYWAQL$eAAAAAa-NH2 | 466 |

TABLE 3c-continued
| Structure | SEQ ID NO: |
|---|---|
| 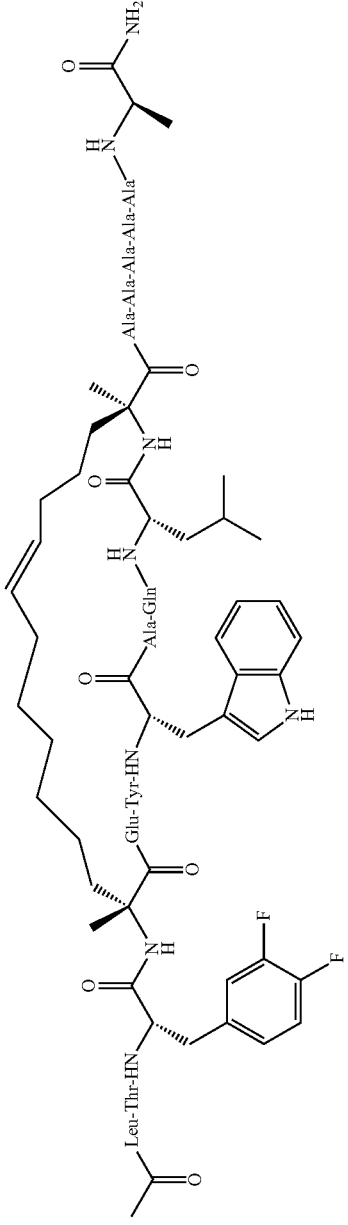<br>Chemical Formula: $C_{95}H_{138}F_2N_{20}O_{23}$<br>Exact Mass: 1965.02<br>Molecular Weight: 1966.23<br>Ac-LTF34F2Ser8EYWAQLS$eAAAAAa-NH2 | 467 |
| 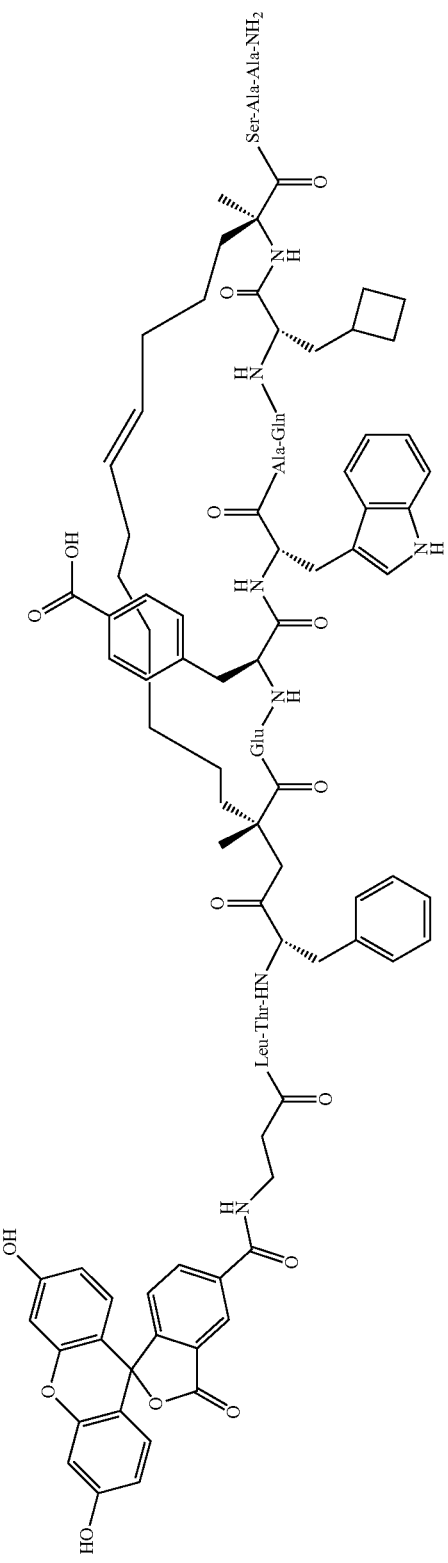<br>5-FAM-BaLTF$er8EYWAQCbaSeSAA-NH2 | 376 |

TABLE 3c-continued
| Structure | SEQ ID NO: |
|---|---|
| 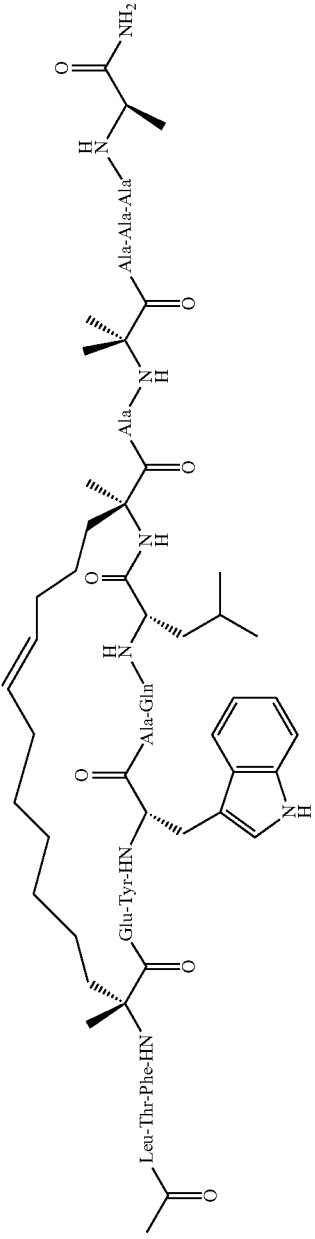 Chemical Formula: $C_{96}H_{142}N_{20}O_{23}$<br>Exact Mass: 1943.06<br>Molecular Weight: 1944.27<br><br>Ac-LTF$Ser8EYWAQL$eAAAibAAAa-NH2 | 471 |
| 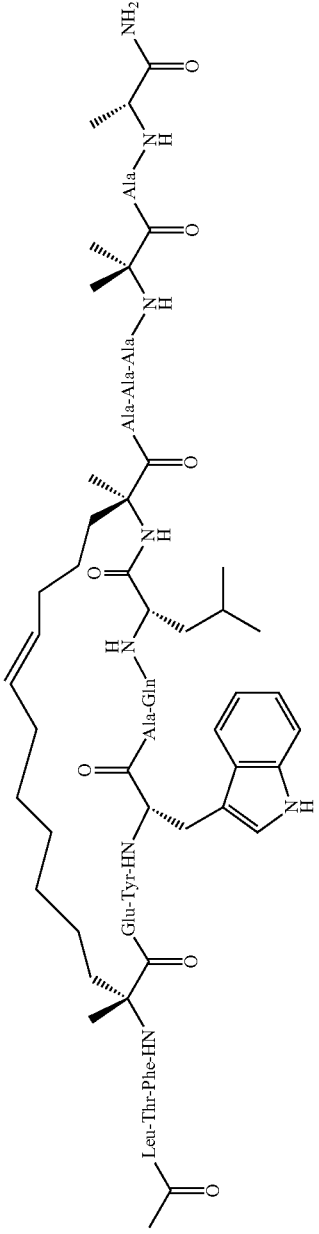 Chemical Formula: $C_{96}H_{142}N_{20}O_{23}$<br>Exact Mass: 1943.06<br>Molecular Weight: 1944.27<br><br>Ac-LTF$Ser8EYWAQL$eAAAAibAa-NH2 | 473 |

TABLE 3c-continued

| Structure | SEQ ID NO: |
|---|---|
| Ac-LTF$Ser8EYWAQL$eAAAAAib&-NH2 | 475 |
| Ac-LTF$Ser8EYWAQL$eAAAAAib-NH2<br>Chemical Formula: C₉₆H₁₄₂N₂₀O₂₃<br>Exact Mass: 1943.06<br>Molecular Weight: 1944.27 | 476 |

TABLE 3c-continued
| Structure | SEQ ID NO: |
|---|---|
| 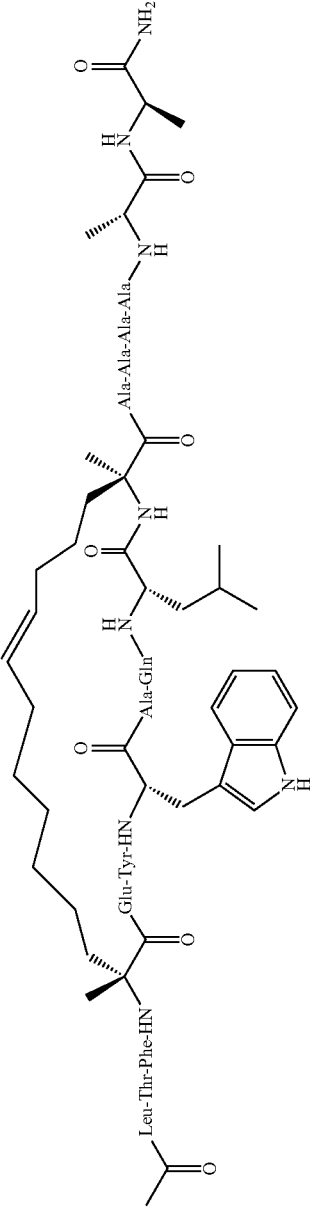 Chemical Formula: C$_{95}$H$_{140}$N$_{20}$O$_{23}$<br>Exact Mass: 1929.04<br>Molecular Weight: 1930.25<br>Ac-LTF$Ser8EYWAQL$eAAAAaa-NH2 | 481 |
| 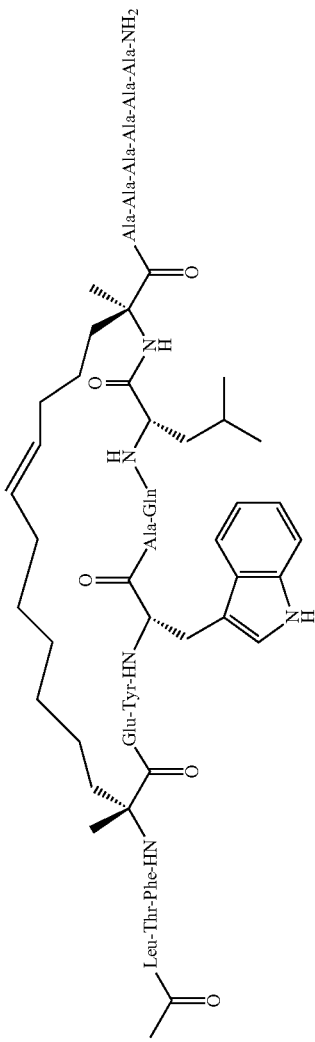 Chemical Formula: C$_{95}$H$_{140}$N$_{20}$O$_{23}$<br>Exact Mass: 1929.04<br>Molecular Weight: 1930.25<br>Ac-LTF$Ser8EYWAQL$eAAAAAA-NH2 | 482 |

TABLE 3c-continued
| Structure | SEQ ID NO: |
|---|---|
| 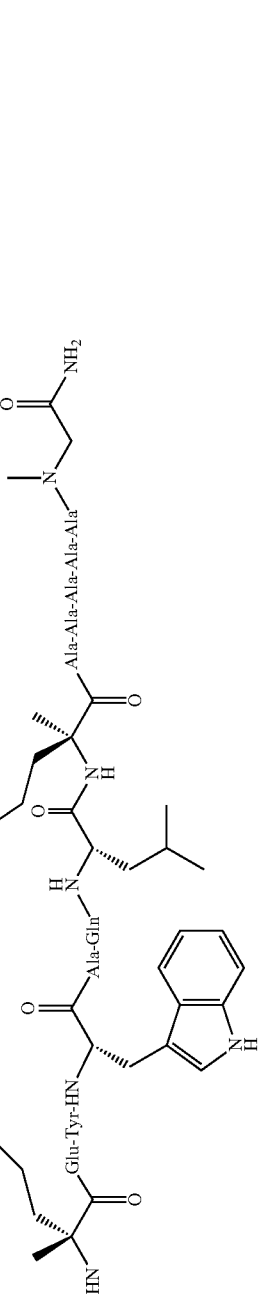  Chemical Formula: C95H140N20O23  Exact Mass: 1929.04  Molecular Weight: 1930.25  Ac-LTF$er8EYWAQL$eAAAAASar-NH2 | 487 |
| 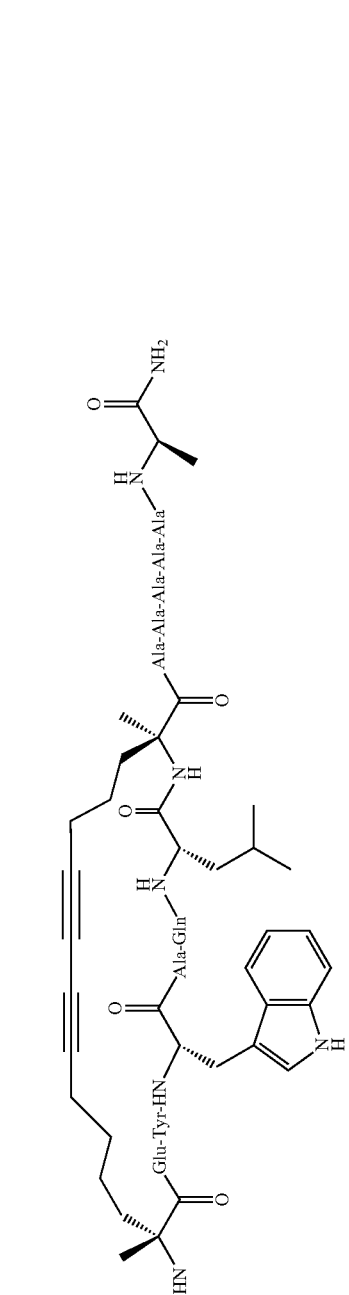  Chemical Formula: C95H134N20O23  Exact Mass: 1922.99  Molecular Weight: 1924.20  Ac-LTF$rda6EYWAQL$da5AAAAAa-NH2 | 572 |

TABLE 3c-continued
| Structure | SEQ ID NO: |
|---|---|
| 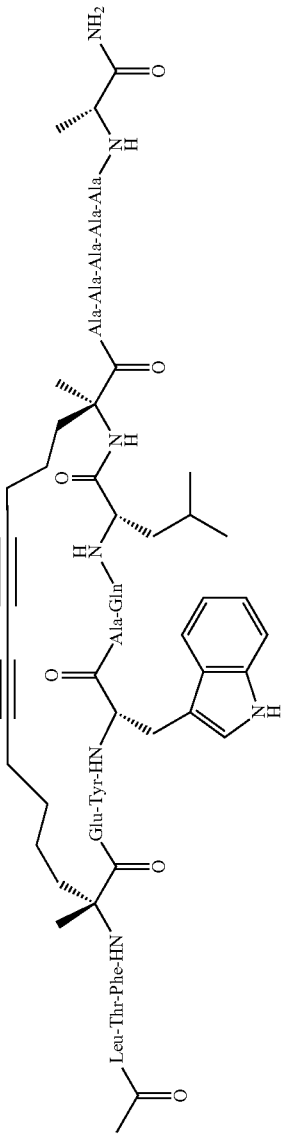 Chemical Formula: $C_{95}H_{134}N_{20}O_{23}$<br>Exact Mass: 1922.99<br>Molecular Weight: 1924.20<br><br>Ac-LTF$rda6EYWAQL$da5AAAAa-NH2 | 572 |
| 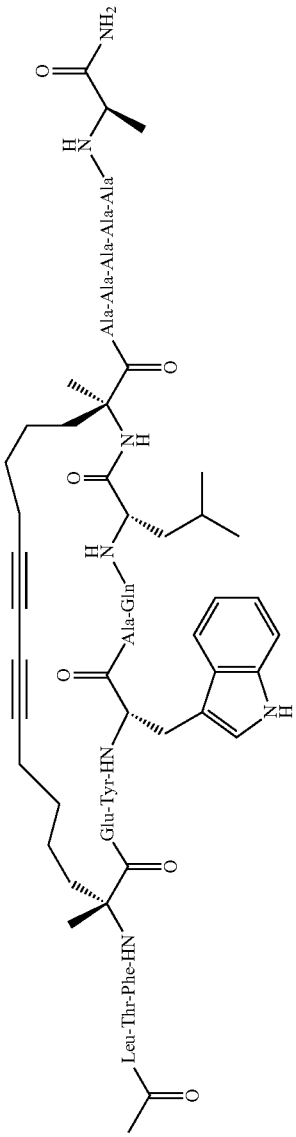 Chemical Formula: $C_{96}H_{136}N_{20}O_{23}$<br>Exact Mass: 1937.01<br>Molecular Weight: 1938.23<br><br>Ac-LTF$rda6EYWAQL$da6AAAAAa-NH2 | 1500 |

In some embodiments, peptidomimetic macrocycles exclude one or more of the peptidomimetic macrocycles shown in Table 4a:

TABLE 4a

| Number | Sequence | SEQ ID NO: |
|---|---|---|
| 1 | L$r5QETFSD$s8WKLLPEN | 693 |
| 2 | LSQ$r5TFSDLW$s8LLPEN | 694 |
| 3 | LSQE$r5FSDLWK$s8LPEN | 695 |
| 4 | LSQET$r5SDLWKL$s8PEN | 696 |
| 5 | LSQETF$r5DLWKLL$s8EN | 697 |
| 6 | LXQETFS$r5LWKLLP$s8N | 698 |
| 7 | LSQETFSD$r5WKLLPE$s8 | 699 |
| 8 | LSQQTF$r5DLWKLL$s8EN | 700 |
| 9 | LSQETF$r5DLWKLL$s8QN | 701 |
| 10 | LSQQTF$r5DLWKLL$s8QN | 702 |
| 11 | LSQETF$r5NLWKLL$s8QN | 703 |
| 12 | LSQQTF$r5NLWKLL$s8QN | 704 |
| 13 | LSQQTF$r5NLWRLL$s8QN | 705 |
| 14 | QSQQTF$r5NLWKLL$s8QN | 706 |
| 15 | QSQQTF$r5NLWRLL$s8QN | 707 |
| 16 | QSQQTA$r5NLWRLL$s8QN | 708 |
| 17 | L$r8QETFSD$WKLLPEN | 709 |
| 18 | LSQ$r8TFSDLW$LLPEN | 710 |
| 19 | LSQE$r8FSDLWK$LPEN | 711 |
| 20 | LSQET$r8SDLWKL$PEN | 712 |
| 21 | LSQETF$r8DLWKLL$EN | 713 |
| 22 | LXQETFS$r8LWKLLP$N | 714 |
| 23 | LSQETFSD$r8WKLLPE$ | 715 |
| 24 | LSQQTF$r8DLWKLL$EN | 716 |
| 25 | LSQETF$r8DLWKLL$QN | 717 |
| 26 | LSQQTF$r8DLWKLL$QN | 718 |
| 27 | LSQETF$r8NLWKLL$QN | 719 |
| 28 | LSQQTF$r8NLWKLL$QN | 720 |
| 29 | LSQQTF$r8NLWRLL$QN | 721 |
| 30 | QSQQTF$r8NLWKLL$QN | 722 |

TABLE 4a-continued

| Number | Sequence | SEQ ID NO: |
|---|---|---|
| 31 | QSQQTF$r8NLWRLL$QN | 723 |
| 32 | QSQQTA$r8NLWRLL$QN | 724 |
| 33 | QSQQTF$r8NLWRKK$QN | 725 |
| 34 | QQTF$r8DLWRLL$EN | 726 |
| 35 | QQTF$r8DLWRLL$ | 727 |
| 36 | LSQQTF$DLW$LL | 728 |
| 37 | QQTF$DLW$LL | 729 |
| 38 | QQTA$r8DLWRLL$EN | 730 |
| 39 | QSQQTF$r5NLWRLL$s8QN (dihydroxylated alkylene crosslink) | 731 |
| 40 | QSQQTA$r5NLWRLL$s8QN (dihydroxylated alkylene crosslink) | 732 |
| 41 | QSQQTF$r8DLWRLL$QN | 733 |
| 42 | QTF$r8NLWRLL$ | 734 |
| 43 | QSQQTF$NLW$LLPQN | 735 |
| 44 | QS$QTF$NLWRLLPQN | 736 |
| 45 | $TFS$LWKLL | 737 |
| 46 | ETF$DLW$LL | 738 |
| 47 | QTF$NLW$LL | 739 |
| 48 | $SQE$FSNLWKLL | 740 |

In Table 4a, X represents S or any amino acid. Peptides shown cam comprise an N-terminal capping group such as acetyl or an additional linker such as beta-alanine between the capping group and the start of the peptide sequence.

In some embodiments, peptidomimetic macrocycles do not comprise a peptidomimetic macrocycle structure as shown in Table 4a.

In other embodiments, peptidomimetic macrocycles exclude one or more of the peptidomimetic macrocycles shown in Table 4b:

TABLE 4b

| Number | Sequence | SEQ ID NO: | Exact Mass | M + 2 | Observed mass (m/e) |
|---|---|---|---|---|---|
| 1 | Ac-LSQETF$r8DLWKLL$EN-NH2 | 741 | 2068.13 | 1035.07 | 1035.36 |
| 2 | Ac-LSQETF$r8NLWKLL$QN-NH2 | 742 | 2066.16 | 1034.08 | 1034.31 |
| 3 | Ac-LSQQTF$r8NLWRLL$QN-NH2 | 743 | 2093.18 | 1047.59 | 1047.73 |
| 4 | Ac-QSQQTF$r8NLWKLL$QN-NH2 | 744 | 2080.15 | 1041.08 | 1041.31 |
| 5 | Ac-QSQQTF$r8NLWRLL$QN-NH2 | 745 | 2108.15 | 1055.08 | 1055.32 |
| 6 | Ac-QSQQTA$r8NLWRLL$QN-NH2 | 746 | 2032.12 | 1017.06 | 1017.24 |
| 7 | Ac-QAibQQTF$r8NLWRLL$QN-NH2 | 747 | 2106.17 | 1054.09 | 1054.34 |
| 8 | Ac-QSQQTFSNLWRLLPQN-NH2 | 748 | 2000.02 | 1001.01 | 1001.26 |
| 9 | Ac-QSQQTF$/r8NLWRLL$/QN-NH2 | 749 | 2136.18 | 1069.09 | 1069.37 |
| 10 | Ac-QSQAibTF$r8NLWRLL$QN-NH2 | 750 | 2065.15 | 1033.58 | 1033.71 |
| 11 | Ac-QSQQTF$r8NLWRLL$AN-NH2 | 751 | 2051.13 | 1026.57 | 1026.70 |
| 12 | Ac-ASQQTF$r8NLWRLL$QN-NH2 | 752 | 2051.13 | 1026.57 | 1026.90 |
| 13 | Ac-QSQQTF$r8ALWRLL$QN-NH2 | 753 | 2065.15 | 1033.58 | 1033.41 |
| 14 | Ac-QSQETF$r8NLWRLL$QN-NH2 | 754 | 2109.14 | 1055.57 | 1055.70 |
| 15 | Ac-RSQQTF$r8NLWRLL$QN-NH2 | 755 | 2136.20 | 1069.10 | 1069.17 |
| 16 | Ac-RSQQTF$r8NLWRLL$EN-NH2 | 756 | 2137.18 | 1069.59 | 1069.75 |
| 17 | Ac-LSQETFSDLWKLLPEN-NH2 | 757 | 1959.99 | 981.00 | 981.24 |
| 18 | Ac-QSQ$TFS$LWRLLPQN-NH2 | 758 | 2008.09 | 1005.05 | 1004.97 |
| 19 | Ac-QSQQ$FSN$WRLLPQN-NH2 | 759 | 2036.06 | 1019.03 | 1018.86 |
| 20 | Ac-QSQQT$SNL$RLLPQN-NH2 | 760 | 1917.04 | 959.52 | 959.32 |
| 21 | Ac-QSQQTF$NLW$LLPQN-NH2 | 761 | 2007.06 | 1004.53 | 1004.97 |
| 22 | Ac-RTQATF$r8NQWAibANle$TNAibTR-NH2 | 762 | 2310.26 | 1156.13 | 1156.52 |
| 23 | Ac-QSQQTF$r8NLWRLL$RN-NH2 | 763 | 2136.20 | 1069.10 | 1068.94 |
| 24 | Ac-QSQRTF$r8NLWRLL$QN-NH2 | 764 | 2136.20 | 1069.10 | 1068.94 |
| 25 | Ac-QSQQTF$r8NNleWRLL$QN-NH2 | 765 | 2108.15 | 1055.08 | 1055.44 |
| 26 | Ac-QSQQTF$r8NLWRNleL$QN-NH2 | 766 | 2108.15 | 1055.08 | 1055.84 |
| 27 | Ac-QSQQTF$r8NLWRLNle$QN-NH2 | 767 | 2108.15 | 1055.08 | 1055.12 |
| 28 | Ac-QSQQTY$r8NLWRLL$QN-NH2 | 768 | 2124.15 | 1063.08 | 1062.92 |
| 29 | Ac-RAibQQTF$r8NLWRLL$QN-NH2 | 769 | 2134.22 | 1068.11 | 1068.65 |
| 30 | Ac-MPRFMDYWEGLN-NH2 | 770 | 1598.70 | 800.35 | 800.45 |
| 31 | Ac-RSQQRF$r8NLWRLL$QN-NH2 | 771 | 2191.25 | 1096.63 | 1096.83 |
| 32 | Ac-QSQQRF$r8NLWRLL$QN-NH2 | 772 | 2163.21 | 1082.61 | 1082.87 |
| 33 | Ac-RAibQQRF$r8NLWRLL$QN-NH2 | 773 | 2189.27 | 1095.64 | 1096.37 |
| 34 | Ac-RSQQRF$r8NFWRLL$QN-NH2 | 774 | 2225.23 | 1113.62 | 1114.37 |
| 35 | Ac-RSQQRF$r8NYWRLL$QN-NH2 | 775 | 2241.23 | 1121.62 | 1122.37 |
| 36 | Ac-RSQQTF$r8NLWQLL$QN-NH2 | 776 | 2108.15 | 1055.08 | 1055.29 |

TABLE 4b-continued

| Number | Sequence | SEQ ID NO: | Exact Mass | M + 2 | Observed mass (m/e) |
|---|---|---|---|---|---|
| 37 | Ac-QSQQTF$r8NLWQAmlL$QN-NH2 | 777 | 2094.13 | 1048.07 | 1048.32 |
| 38 | Ac-QSQQTF$r8NAmlWRLL$QN-NH2 | 778 | 2122.17 | 1062.09 | 1062.35 |
| 39 | Ac-NlePRF$r8DYWEGL$QN-NH2 | 779 | 1869.98 | 935.99 | 936.20 |
| 40 | Ac-NlePRF$r8NYWRLL$QN-NH2 | 780 | 1952.12 | 977.06 | 977.35 |
| 41 | Ac-RF$r8NLWRLL$Q-NH2 | 781 | 1577.96 | 789.98 | 790.18 |
| 42 | Ac-QSQQTF$r8N2ffWRLL$QN-NH2 | 782 | 2160.13 | 1081.07 | 1081.40 |
| 43 | Ac-QSQQTF$r8N3ffWRLL$QN-NH2 | 783 | 2160.13 | 1081.07 | 1081.34 |
| 44 | Ac-QSQQTF#r8NLWRLL#QN-NH2 | 784 | 2080.12 | 1041.06 | 1041.34 |
| 45 | Ac-RSQQTA$r8NLWRLL$QN-NH2 | 785 | 2060.16 | 1031.08 | 1031.38 |
| 46 | Ac-QSQQTF%r8NLWRLL%QN-NH2 | 786 | 2110.15 | 1056.09 | 1056.55 |
| 47 | HepQSQ$TFSNLWRLLPQN-NH2 | 787 | 2051.10 | 1026.55 | 1026.82 |
| 48 | HepQSQ$TF$r8NLWRLL$QN-NH2 | 788 | 2159.23 | 1080.62 | 1080.89 |
| 49 | Ac-QSQQTF$r8NL6clWRLL$QN-NH2 | 789 | 2142.11 | 1072.06 | 1072.35 |
| 50 | Ac-QSQQTF$r8NLMe6clwRLL$QN-NH2 | 790 | 2156.13 | 1079.07 | 1079.27 |
| 51 | Ac-LTFEHYWAQLTS-NH2 | 791 | 1535.74 | 768.87 | 768.91 |
| 52 | Ac-LTF$HYW$QLTS-NH2 | 792 | 1585.83 | 793.92 | 794.17 |
| 53 | Ac-LTFE$YWA$LTS-NH2 | 793 | 1520.79 | 761.40 | 761.67 |
| 54 | Ac-LTF$zr8HYWAQL$zS-NH2 | 794 | 1597.87 | 799.94 | 800.06 |
| 55 | Ac-LTF$r8HYWRQL$S-NH2 | 795 | 1682.93 | 842.47 | 842.72 |
| 56 | Ac-QS$QTFStNLWRLL$s8QN-NH2 | 796 | 2145.21 | 1073.61 | 1073.90 |
| 57 | Ac-QSQQTASNLWRLLPQN-NH2 | 797 | 1923.99 | 963.00 | 963.26 |
| 58 | Ac-QSQQTA$/r8NLWRLL$/QN-NH2 | 798 | 2060.15 | 1031.08 | 1031.24 |
| 59 | Ac-ASQQTF$/r8NLWRLL$/QN-NH2 | 799 | 2079.15 | 1040.58 | 1040.89 |
| 60 | Ac-$SQQ$FSNLWRLLAibQN-NH2 | 800 | 2009.09 | 1005.55 | 1005.86 |
| 61 | Ac-QS$QTF$NLWRLLAibQN-NH2 | 801 | 2023.10 | 1012.55 | 1012.79 |
| 62 | Ac-QSQQ$FSN$WRLLAibQN-NH2 | 802 | 2024.06 | 1013.03 | 1013.31 |
| 63 | Ac-QSQQTF$NLW$LLAibQN-NH2 | 803 | 1995.06 | 998.53 | 998.87 |
| 64 | Ac-QSQQTFS$LWR$LAibQN-NH2 | 804 | 2011.06 | 1006.53 | 1006.83 |
| 65 | Ac-QSQQTFSNLW$LLA$N-NH2 | 805 | 1940.02 | 971.01 | 971.29 |
| 66 | Ac-$/SQQ$/FSNLWRLLAibQN-NH2 | 806 | 2037.12 | 1019.56 | 1019.78 |
| 67 | Ac-QS$/QTF$/NLWRLLAibQN-NH2 | 807 | 2051.13 | 1026.57 | 1026.90 |
| 68 | Ac-QSQQ$/FSN$AVRLLAibQN-NH2 | 808 | 2052.09 | 1027.05 | 1027.36 |
| 69 | Ac-QSQQTF$/NLW$/LLAibQN-NH2 | 809 | 2023.09 | 1012.55 | 1013.82 |
| 70 | Ac-QSQ$TFS$LWRLLAibQN-NH2 | 810 | 1996.09 | 999.05 | 999.39 |
| 71 | Ac-QSQ$/TFS$/LWRLLAibQN-NH2 | 811 | 2024.12 | 1013.06 | 1013.37 |
| 72 | Ac-QS$/QTFSt//NLWRLL$/s8QN-NH2 | 812 | 2201.27 | 1101.64 | 1102.00 |
| 73 | Ac-$r8SQQTFS$LWRLLAibQN-NH2 | 813 | 2038.14 | 1020.07 | 1020.23 |
| 74 | Ac-QSQ$r8TFSNLW$LLAibQN-NH2 | 814 | 1996.08 | 999.04 | 999.32 |
| 75 | Ac-QSQQTFS$r8LWRLLA$N-NH2 | 815 | 2024.12 | 1013.06 | 1013.37 |
| 76 | Ac-QS$r5QTFStNLW$LLAibQN-NH2 | 816 | 2032.12 | 1017.06 | 1017.39 |
| 77 | Ac-$/r8SQQTFS$/LWRLLAibQN-NH2 | 817 | 2066.17 | 1034.09 | 1034.80 |
| 78 | Ac-QSQ$/r8TFSNLW$/LLAibQN-NH2 | 818 | 2024.11 | 1013.06 | 1014.34 |
| 79 | Ac-QSQQTFS$/r8LWRLLA$/N-NH2 | 819 | 2052.15 | 1027.08 | 1027.16 |
| 80 | Ac-QS$/r5QTFSt//NLW$/LLAibQN-NH2 | 820 | 2088.18 | 1045.09 | 1047.10 |
| 81 | Ac-QSQQTFSNLWRLLAibQN-NH2 | 821 | 1988.02 | 995.01 | 995.31 |
| 82 | Hep/QSQ$/TF$/r8NLWRLL$/QN-NH2 | 822 | 2215.29 | 1108.65 | 1108.93 |
| 83 | Ac-ASQQTF$r8NLRWLL$QN-NH2 | 823 | 2051.13 | 1026.57 | 1026.90 |
| 84 | Ac-QSQQTF$/r8NLWRLL$/Q-NH2 | 824 | 2022.14 | 1012.07 | 1012.66 |
| 85 | Ac-QSQQTF$r8NLWRLL$Q-NH2 | 825 | 1994.11 | 998.06 | 998.42 |
| 86 | Ac-AAARAA$r8AAARAA$AA-NH2 | 826 | 1515.90 | 758.95 | 759.21 |
| 87 | Ac-LTFEHYWAQLTSA-NH2 | 827 | 1606.78 | 804.39 | 804.59 |
| 88 | Ac-LTF$r8HYWAQL$SA-NH2 | 828 | 1668.90 | 835.45 | 835.67 |
| 89 | Ac-ASQQTFSNLWRLLPQN-NH2 | 829 | 1943.00 | 972.50 | 973.27 |
| 90 | Ac-QS$QTFStNLW$r5LLAibQN-NH2 | 830 | 2032.12 | 1017.06 | 1017.30 |
| 91 | Ac-QSQQTFAibNLWRLLAibQN-NH2 | 831 | 1986.04 | 994.02 | 994.19 |
| 92 | Ac-QSQQTFNleNLWRLLNleQN-NH2 | 832 | 2042.11 | 1022.06 | 1022.23 |
| 93 | Ac-QSQQTF$/r8NLWRLLAibQN-NH2 | 833 | 2082.14 | 1042.07 | 1042.23 |
| 94 | Ac-QSQQTF$/r8NLWRLLNleQN-NH2 | 834 | 2110.17 | 1056.09 | 1056.29 |
| 95 | Ac-QSQQTFAibNLWRLL$/QN-NH2 | 835 | 2040.09 | 1021.05 | 1021.25 |
| 96 | Ac-QSQQTFNleNLWRLL$/QN-NH2 | 836 | 2068.12 | 1035.06 | 1035.31 |
| 97 | Ac-QSQQTF%r8NL6clWRNleL%QN-NH2 | 837 | 2144.13 | 1073.07 | 1073.32 |
| 98 | Ac-QSQQTF%r8NLMe6clWRLL%QN-NH2 | 838 | 2158.15 | 1080.08 | 1080.31 |
| 101 | Ac-FNle$YWE$L-NH2 | 839 | 1160.63 | — | 1161.70 |
| 102 | Ac-F$r8AYWELL$A-NH2 | 840 | 1344.75 | — | 1345.90 |
| 103 | Ac-F$r8AYWQLL$A-NH2 | 841 | 1343.76 | — | 1344.83 |
| 104 | Ac-NlePRF$r8NYWELL$QN-NH2 | 842 | 1925.06 | 963.53 | 963.69 |
| 105 | Ac-NlePRF$r8DYWRLL$QN-NH2 | 843 | 1953.10 | 977.55 | 977.68 |
| 106 | Ac-NlePRF$r8NYWRLL$Q-NH2 | 844 | 1838.07 | 920.04 | 920.18 |
| 107 | Ac-NlePRF$r8NYWRLL$-NH2 | 845 | 1710.01 | 856.01 | 856.13 |
| 108 | Ac-QSQQTF$r8DLWRLL$QN-NH2 | 846 | 2109.14 | 1055.57 | 1055.64 |
| 109 | Ac-QSQQTF$r8NLWRLL$EN-NH2 | 847 | 2109.14 | 1055.57 | 1055.70 |
| 110 | Ac-QSQQTF$r8NLWRLL$QD-NH2 | 848 | 2109.14 | 1055.57 | 1055.64 |
| 111 | Ac-QSQQTF$r8NLWRLL$S-NH2 | 849 | 1953.08 | 977.54 | 977.60 |
| 112 | Ac-ESQQTF$r8NLWRLL$QN-NH2 | 850 | 2109.14 | 1055.57 | 1055.70 |
| 113 | Ac-LTF$r8NLWRNleL$Q-NH2 | 851 | 1635.99 | 819.00 | 819.10 |
| 114 | Ac-LRF$r8NLWRNleL$Q-NH2 | 852 | 1691.04 | 846.52 | 846.68 |
| 115 | Ac-QSQQTF$r8NWWRNleL$QN-NH2 | 853 | 2181.15 | 1091.58 | 1091.64 |

TABLE 4b-continued

| Number | Sequence | SEQ ID NO: | Exact Mass | M + 2 | Observed mass (m/e) |
|---|---|---|---|---|---|
| 116 | Ac-QSQQTF$r8NLWRNleL$Q-NH2 | 854 | 1994.11 | 998.06 | 998.07 |
| 117 | Ac-QTF$r8NLWRNleL$QN-NH2 | 855 | 1765.00 | 883.50 | 883.59 |
| 118 | Ac-NlePRF$r8NWWRLL$QN-NH2 | 856 | 1975.13 | 988.57 | 988.75 |
| 119 | Ac-NlePRF$r8NWWRLL$A-NH2 | 857 | 1804.07 | 903.04 | 903.08 |
| 120 | Ac-TSFAEYWNLLNH2 | 858 | 1467.70 | 734.90 | 734.90 |
| 121 | Ac-QTF$r8HWWSQL$S-NH2 | 859 | 1651.85 | 826.93 | 827.12 |
| 122 | Ac-FM$YWE$L-NH2 | 860 | 1178.58 | — | 1179.64 |
| 123 | Ac-QTFEHWWSQLLS-NH2 | 861 | 1601.76 | 801.88 | 801.94 |
| 124 | Ac-QSQQTF$r8NLAmwRLNle$QN-NH2 | 862 | 2122.17 | 1062.09 | 1062.24 |
| 125 | Ac-FMAibY6clWEAc3cL-NH2 | 863 | 1130.47 | — | 1131.53 |
| 126 | Ac-FNle$Y6clWE$L-NH2 | 864 | 1194.59 | — | 1195.64 |
| 127 | Ac-F$zr8AY6clWEAc3cL$z-NH2 | 865 | 1277.63 | 639.82 | 1278.71 |
| 128 | Ac-F$r8AY6clWEAc3cL$A-NH2 | 866 | 1348.66 | — | 1350.72 |
| 129 | Ac-NlePRF$r8NY6clWRLL$QN-NH2 | 867 | 1986.08 | 994.04 | 994.64 |
| 130 | Ac-AF$r8AAWALA$A-NH2 | 868 | 1223.71 | — | 1224.71 |
| 131 | Ac-TF$r8AAWRLA$Q-NH2 | 869 | 1395.80 | 698.90 | 399.04 |
| 132 | Pr-TF$r8AAWRLA$Q-NH2 | 870 | 1409.82 | 705.91 | 706.04 |
| 133 | Ac-QSQQTF%r8NLWRNleL%QN-NH2 | 871 | 2110.15 | 1056.09 | 1056.22 |
| 134 | Ac-LTF%r8HYWAQL%SA-NH2 | 872 | 1670.92 | 836.46 | 836.58 |
| 135 | Ac-NlePRF%r8NYWRLL%QN-NH2 | 873 | 1954.13 | 978.07 | 978.19 |
| 136 | Ac-NlePRF%r8NY6clWRLL%QN-NH2 | 874 | 1988.09 | 995.05 | 995.68 |
| 137 | Ac-LTF%r8HY6clWAQL%S-NH2 | 875 | 1633.84 | 817.92 | 817.93 |
| 138 | Ac-QS%QTF%StNLWRLL%s8QN-NH2 | 876 | 2149.24 | 1075.62 | 1075.65 |
| 139 | Ac-LTF%r8HY6clWRQL%S-NH2 | 877 | 1718.91 | 860.46 | 860.54 |
| 140 | Ac-QSQQTF%r8NL6clWRLL%QN-NH2 | 878 | 2144.13 | 1073.07 | 1073.64 |
| 141 | Ac-%r8SQQTFS%LWRLLAibQN-NH2 | 879 | 2040.15 | 1021.08 | 1021.13 |
| 142 | Ac-LTF%r8HYWAQL%S-NH2 | 880 | 1599.88 | 800.94 | 801.09 |
| 143 | Ac-TSF%r8QYWNLL%P-NH2 | 881 | 1602.88 | 802.44 | 802.58 |
| 147 | Ac-LTFEHYWAQLTS-NH2 | 882 | 1535.74 | 768.87 | 769.5 |
| 152 | Ac-F$er8AY6clWEAc3cL$e-NH2 | 883 | 1277.63 | 639.82 | 1278.71 |
| 153 | Ac-AF$r8AAWALA$A-NH2 | 884 | 1277.63 | 639.82 | 1277.84 |
| 154 | Ac-TF$r8AAWRLA$Q-NH2 | 885 | 1395.80 | 698.90 | 699.04 |
| 155 | Pr-TF$r8AAWRLA$Q-NH2 | 886 | 1409.82 | 705.91 | 706.04 |
| 156 | Ac-LTF$er8HYWAQL$eS-NH2 | 887 | 1597.87 | 799.94 | 800.44 |
| 159 | Ac-CCPGCCBaQSQQTF$r8NLWRLL$QN-NH2 | 888 | 2745.30 | 1373.65 | 1372.99 |
| 160 | Ac-CCPGCCBaQSQQTA$r8NLWRLL$QN-NH2 | 889 | 2669.27 | 1335.64 | 1336.09 |
| 161 | Ac-CCPGCCBaNlePRF$r8NYWRLL$QN-NH2 | 890 | 2589.26 | 1295.63 | 1296.2 |
| 162 | Ac-LTF$/r8HYWAQL$/S-NH2 | 891 | 1625.90 | 813.95 | 814.18 |
| 163 | Ac-F%r8HY6clWRAc3cL%-NH2 | 892 | 1372.72 | 687.36 | 687.59 |
| 164 | Ac-QTF%r8HWWSQL%S-NH2 | 893 | 1653.87 | 827.94 | 827.94 |
| 165 | Ac-LTA$r8HYWRQL$S-NH2 | 894 | 1606.90 | 804.45 | 804.66 |
| 166 | Ac-Q$r8QQTFSN$WRLLAibQN-NH2 | 895 | 2080.12 | 1041.06 | 1041.61 |
| 167 | Ac-QSQQ$r8FSNLWR$LAibQN-NH2 | 896 | 2066.11 | 1034.06 | 1034.58 |
| 168 | Ac-F$r8AYWEAc3cL$A-NH2 | 897 | 1314.70 | 658.35 | 1315.88 |
| 169 | Ac-F$r8AYWEAc3cL$S-NH2 | 898 | 1330.70 | 666.35 | 1331.87 |
| 170 | Ac-F$r8AYWEAc3cL$Q-NH2 | 899 | 1371.72 | 686.86 | 1372.72 |
| 171 | Ac-F$r8AYWEAibL$S-NH2 | 900 | 1332.71 | 667.36 | 1334.83 |
| 172 | Ac-F$r8AYWEAL$S-NH2 | 901 | 1318.70 | 660.35 | 1319.73 |
| 173 | Ac-F$r8AYWEQL$S-NH2 | 902 | 1375.72 | 688.86 | 1377.53 |
| 174 | Ac-F$r8HYWEQL$S-NH2 | 903 | 1441.74 | 721.87 | 1443.48 |
| 175 | Ac-F$r8HYWAQL$S-NH2 | 904 | 1383.73 | 692.87 | 1385.38 |
| 176 | Ac-F$r8HYWAAc3cL$S-NH2 | 905 | 1338.71 | 670.36 | 1340.82 |
| 177 | Ac-F$r8HYWRAc3cL$S-NH2 | 906 | 1423.78 | 712.89 | 713.04 |
| 178 | Ac-F$r8AYWEAc3cL#A-NH2 | 907 | 1300.69 | 651.35 | 1302.78 |
| 179 | Ac-NlePTF%r8NYWRLL%QN-NH2 | 908 | 1899.10 | 950.56 | 950.56 |
| 180 | Ac-TF$r8AAWRAL$Q-NH2 | 909 | 1395.80 | 698.90 | 699.13 |
| 181 | Ac-TSF%r8HYWAQL%S-NH2 | 910 | 1573.83 | 787.92 | 787.98 |
| 184 | Ac-F%r8AY6clWEAc3cL%A-NH2 | 911 | 1350.68 | 676.34 | 676.91 |
| 185 | Ac-LTF$r8HYWAQI$S-NH2 | 912 | 1597.87 | 799.94 | 800.07 |
| 186 | Ac-LTF$r8HYWAQNle$S-NH2 | 913 | 1597.87 | 799.94 | 800.07 |
| 187 | Ac-LTF$r8HYWAQL$A-NH2 | 914 | 1581.87 | 791.94 | 792.45 |
| 188 | Ac-LTF$r8HYWAQL$Abu-NH2 | 915 | 1595.89 | 798.95 | 799.03 |
| 189 | Ac-LTF$r8HYWAbuQL$S-NH2 | 916 | 1611.88 | 806.94 | 807.47 |
| 190 | Ac-LTF$er8AYWAQL$eS-NH2 | 917 | 1531.84 | 766.92 | 766.96 |
| 191 | Ac-LAF$r8HYWAQL$S-NH2 | 918 | 1567.86 | 784.93 | 785.49 |
| 192 | Ac-LAF$r8AYWAQL$S-NH2 | 919 | 1501.83 | 751.92 | 752.01 |
| 193 | Ac-LTF$er8AYWAQL$eA-NH2 | 920 | 1515.85 | 758.93 | 758.97 |
| 194 | Ac-LAF$r8AYWAQL$A-NH2 | 921 | 1485.84 | 743.92 | 744.05 |
| 195 | Ac-LTF$r8NLWANleL$Q-NH2 | 922 | 1550.92 | 776.46 | 776.61 |
| 196 | Ac-LTF$r8NLWANleL$A-NH2 | 923 | 1493.90 | 747.95 | 1495.6 |
| 197 | Ac-LTF$r8ALWANleL$Q-NH2 | 924 | 1507.92 | 754.96 | 755 |
| 198 | Ac-LAF$r8NLWANleL$Q-NH2 | 925 | 1520.91 | 761.46 | 761.96 |
| 199 | Ac-LAF$r8ALWANleL$A-NH2 | 926 | 1420.89 | 711.45 | 1421.74 |
| 200 | Ac-A$r8AYWEAc3cL$A-NH2 | 927 | 1238.67 | 620.34 | 1239.65 |
| 201 | Ac-F$r8AYWEAc3cL$AA-NH2 | 928 | 1385.74 | 693.87 | 1386.64 |
| 202 | Ac-F$r8AYWEAc3cL$Abu-NH2 | 929 | 1328.72 | 665.36 | 1330.17 |
| 203 | Ac-F$r8AYWEAc3cL$Nle-NH2 | 930 | 1356.75 | 679.38 | 1358.22 |

TABLE 4b-continued

| Number | Sequence | SEQ ID NO: | Exact Mass | M + 2 | Observed mass (m/e) |
|---|---|---|---|---|---|
| 204 | Ac-F$r5AYWEAc3cL$s8A-NH2 | 931 | 1314.70 | 658.35 | 1315.51 |
| 205 | Ac-F$AYWEAc3cL$r8A-NH2 | 932 | 1314.70 | 658.35 | 1315.66 |
| 206 | Ac-F$r8AYWEAc3cI$A-NH2 | 933 | 1314.70 | 658.35 | 1316.18 |
| 207 | Ac-F$r8AYWEAc3cNle$A-NH2 | 934 | 1314.70 | 658.35 | 1315.66 |
| 208 | Ac-F$r8AYWEAmlL$A-NH2 | 935 | 1358.76 | 680.38 | 1360.21 |
| 209 | Ac-F$r8AYWENleL$A-NH2 | 936 | 1344.75 | 673.38 | 1345.71 |
| 210 | Ac-F$r8AYWQAc3cL$A-NH2 | 937 | 1313.72 | 657.86 | 1314.7 |
| 211 | Ac-F$r8AYWAAc3cL$A-NH2 | 938 | 1256.70 | 629.35 | 1257.56 |
| 212 | Ac-F$r8AYWAbuAc3cL$A-NH2 | 939 | 1270.71 | 636.36 | 1272.14 |
| 213 | Ac-F$r8AYWNleAc3cL$A-NH2 | 940 | 1298.74 | 650.37 | 1299.67 |
| 214 | Ac-F$r8AbuYWEAc3cL$A-NH2 | 941 | 1328.72 | 665.36 | 1329.65 |
| 215 | Ac-F$r8NleYWEAc3cL$A-NH2 | 942 | 1356.75 | 679.38 | 1358.66 |
| 216 | 5-FAM-BaLTFEHYWAQLTS-NH2 | 943 | 1922.82 | 962.41 | 962.87 |
| 217 | 5-FAM-BaLTF%r8HYWAQL%S-NH2 | 944 | 1986.96 | 994.48 | 994.97 |
| 218 | Ac-LTF$r8HYWAQhL$S-NH2 | 945 | 1611.88 | 806.94 | 807 |
| 219 | Ac-LTF$r8HYWAQTle$S-NH2 | 946 | 1597.87 | 799.94 | 799.97 |
| 220 | Ac-LTF$r8HYWAQAdm$S-NH2 | 947 | 1675.91 | 838.96 | 839.09 |
| 221 | Ac-LTF$r8HYWAQhCha$S-NH2 | 948 | 1651.91 | 826.96 | 826.98 |
| 222 | Ac-LTF$r8HYWAQCha$S-NH2 | 949 | 1637.90 | 819.95 | 820.02 |
| 223 | Ac-LTF$r8HYWAc6cQL$S-NH2 | 950 | 1651.91 | 826.96 | 826.98 |
| 224 | Ac-LTF$r8HYWAc5cQL$S-NH2 | 951 | 1637.90 | 819.95 | 820.02 |
| 225 | Ac-LThF$r8HYWAQL$S-NH2 | 952 | 1611.88 | 806.94 | 807 |
| 226 | Ac-LTIgl$r8HYWAQL$S-NH2 | 953 | 1625.90 | 813.95 | 812.99 |
| 227 | Ac-LTF$r8HYWAQChg$S-NH2 | 954 | 1623.88 | 812.94 | 812.99 |
| 228 | Ac-LTF$r8HYWAQF$S-NH2 | 955 | 1631.85 | 816.93 | 816.99 |
| 229 | Ac-LTF$r8HYWAQIgl$S-NH2 | 956 | 1659.88 | 830.94 | 829.94 |
| 230 | Ac-LTF$r8HYWAQCba$S-NH2 | 957 | 1609.87 | 805.94 | 805.96 |
| 231 | Ac-LTF$r8HYWAQCpg$S-NH2 | 958 | 1609.87 | 805.94 | 805.96 |
| 232 | Ac-LTF$r8HhYWAQL$S-NH2 | 959 | 1611.88 | 806.94 | 807 |
| 233 | Ac-F$r8AYWEAc3chL$A-NH2 | 960 | 1328.72 | 665.36 | 665.43 |
| 234 | Ac-F$r8AYWEAc3cTle$A-NH2 | 961 | 1314.70 | 658.35 | 1315.62 |
| 235 | Ac-F$r8AYWEAc3cAdm$A-NH2 | 962 | 1392.75 | 697.38 | 697.47 |
| 236 | Ac-F$r8AYWEAc3chCha$A-NH2 | 963 | 1368.75 | 685.38 | 685.34 |
| 237 | Ac-F$r8AYWEAc3cCha$A-NH2 | 964 | 1354.73 | 678.37 | 678.38 |
| 238 | Ac-F$r8AYWEAc6cL$A-NH2 | 965 | 1356.75 | 679.38 | 679.42 |
| 239 | Ac-F$r8AYWEAc5cL$A-NH2 | 966 | 1342.73 | 672.37 | 672.46 |
| 240 | Ac-hF$r8AYWEAc3cL$A-NH2 | 967 | 1328.72 | 665.36 | 665.43 |
| 241 | Ac-Igl$r8AYWEAc3cL$A-NH2 | 968 | 1342.73 | 672.37 | 671.5 |
| 243 | Ac-F$r8AYWEAc3cF$A-NH2 | 969 | 1348.69 | 675.35 | 675.35 |
| 244 | Ac-F$r8AYWEAc3cIgl$A-NH2 | 970 | 1376.72 | 689.36 | 688.37 |
| 245 | Ac-F$r8AYWEAc3cCba$A-NH2 | 971 | 1326.70 | 664.35 | 664.47 |
| 246 | Ac-F$r8AYWEAc3cCpg$A-NH2 | 972 | 1326.70 | 664.35 | 664.39 |
| 247 | Ac-F$r8AhYWEAc3cL$A-NH2 | 973 | 1328.72 | 665.36 | 665.43 |
| 248 | Ac-F$r8AYWEAc3cL$Q-NH2 | 974 | 1371.72 | 686.86 | 1372.87 |
| 249 | Ac-F$r8AYWEAibL$A-NH2 | 975 | 1316.72 | 659.36 | 1318.18 |
| 250 | Ac-F$r8AYWEAL$A-NH2 | 976 | 1302.70 | 652.35 | 1303.75 |
| 251 | Ac-LAF$r8AYWAAL$A-NH2 | 977 | 1428.82 | 715.41 | 715.49 |
| 252 | Ac-LTF$r8HYWAAc3cL$S-NH2 | 978 | 1552.84 | 777.42 | 777.5 |
| 253 | Ac-NleTF$r8HYWAQL$S-NH2 | 979 | 1597.87 | 799.94 | 800.04 |
| 254 | Ac-VTF$r8HYWAQL$S-NH2 | 980 | 1583.85 | 792.93 | 793.04 |
| 255 | Ac-FTF$r8HYWAQL$S-NH2 | 981 | 1631.85 | 816.93 | 817.02 |
| 256 | Ac-WTF$r8HYWAQL$S-NH2 | 982 | 1670.86 | 836.43 | 836.85 |
| 257 | Ac-RTF$r8HYWAQL$S-NH2 | 983 | 1640.88 | 821.44 | 821.9 |
| 258 | Ac-KTF$r8HYWAQL$S-NH2 | 984 | 1612.88 | 807.44 | 807.91 |
| 259 | Ac-LNleF$r8HYWAQL$S-NH2 | 985 | 1609.90 | 805.95 | 806.43 |
| 260 | Ac-LVF$r8HYWAQL$S-NH2 | 986 | 1595.89 | 798.95 | 798.93 |
| 261 | Ac-LFF$r8HYWAQL$S-NH2 | 987 | 1643.89 | 822.95 | 823.38 |
| 262 | Ac-LWF$r8HYWAQL$S-NH2 | 988 | 1682.90 | 842.45 | 842.55 |
| 263 | Ac-LRF$r8HYWAQL$S-NH2 | 989 | 1652.92 | 827.46 | 827.52 |
| 264 | Ac-LKF$r8HYWAQL$S-NH2 | 990 | 1624.91 | 813.46 | 813.51 |
| 265 | Ac-LTF$r8NleYWAQL$S-NH2 | 991 | 1573.89 | 787.95 | 788.05 |
| 266 | Ac-LTF$r8VYWAQL$S-NH2 | 992 | 1559.88 | 780.94 | 780.98 |
| 267 | Ac-LTF$r8FYWAQL$S-NH2 | 993 | 1607.88 | 804.94 | 805.32 |
| 268 | Ac-LTF$r8WYWAQL$S-NH2 | 994 | 1646.89 | 824.45 | 824.86 |
| 269 | Ac-LTF$r8RYWAQL$S-NH2 | 995 | 1616.91 | 809.46 | 809.51 |
| 270 | Ac-LTF$r8KYWAQL$S-NH2 | 996 | 1588.90 | 795.45 | 795.48 |
| 271 | Ac-LTF$r8HNleWAQL$S-NH2 | 997 | 1547.89 | 774.95 | 774.98 |
| 272 | Ac-LTF$r8HVWAQL$S-NH2 | 998 | 1533.87 | 767.94 | 767.95 |
| 273 | Ac-LTF$r8HFWAQL$S-NH2 | 999 | 1581.87 | 791.94 | 792.3 |
| 274 | Ac-LTF$r8HWWAQL$S-NH2 | 1000 | 1620.88 | 811.44 | 811.54 |
| 275 | Ac-LTF$r8HRWAQL$S-NH2 | 1001 | 1590.90 | 796.45 | 796.52 |
| 276 | Ac-LTF$r8HKWAQL$S-NH2 | 1002 | 1562.90 | 782.45 | 782.53 |
| 277 | Ac-LTF$r8HYWNleQL$S-NH2 | 1003 | 1639.91 | 820.96 | 820.98 |
| 278 | Ac-LTF$r8HYWVQL$S-NH2 | 1004 | 1625.90 | 813.95 | 814.03 |
| 279 | Ac-LTF$r8HYWFQL$S-NH2 | 1005 | 1673.90 | 837.95 | 838.03 |
| 280 | Ac-LTF$r8HYWWQL$S-NH2 | 1006 | 1712.91 | 857.46 | 857.5 |
| 281 | Ac-LTF$r8HYWKQL$S-NH2 | 1007 | 1654.92 | 828.46 | 828.49 |

TABLE 4b-continued

| Number | Sequence | SEQ ID NO: | Exact Mass | M + 2 | Observed mass (m/e) |
|---|---|---|---|---|---|
| 282 | Ac-LTF$r8HYWANleL$S-NH2 | 1008 | 1582.89 | 792.45 | 792.52 |
| 283 | Ac-LTF$r8HYWAVL$S-NH2 | 1009 | 1568.88 | 785.44 | 785.49 |
| 284 | Ac-LTF$r8HYWAFL$S-NH2 | 1010 | 1616.88 | 809.44 | 809.47 |
| 285 | Ac-LTF$r8HYWAWL$S-NH2 | 1011 | 1655.89 | 828.95 | 829 |
| 286 | Ac-LTF$r8HYWARL$S-NH2 | 1012 | 1625.91 | 813.96 | 813.98 |
| 287 | Ac-LTF$r8HYWAQL$Nle-NH2 | 1013 | 1623.92 | 812.96 | 813.39 |
| 288 | Ac-LTF$r8HYWAQL$V-NH2 | 1014 | 1609.90 | 805.95 | 805.99 |
| 289 | Ac-LTF$r8HYWAQL$F-NH2 | 1015 | 1657.90 | 829.95 | 830.26 |
| 290 | Ac-LTF$r8HYWAQL$W-NH2 | 1016 | 1696.91 | 849.46 | 849.5 |
| 291 | Ac-LTF$r8HYWAQL$R-NH2 | 1017 | 1666.94 | 834.47 | 834.56 |
| 292 | Ac-LTF$r8HYWAQL$K-NH2 | 1018 | 1638.93 | 820.47 | 820.49 |
| 293 | Ac-Q$r8QQTFSN$WRLLAibQN-NH2 | 1019 | 2080.12 | 1041.06 | 1041.54 |
| 294 | Ac-QSQQ$r8FSNLWR$LAibQN-NH2 | 1020 | 2066.11 | 1034.06 | 1034.58 |
| 295 | Ac-LT2Pal$r8HYWAQL$S-NH2 | 1021 | 1598.86 | 800.43 | 800.49 |
| 296 | Ac-LT3Pal$r8HYWAQL$S-NH2 | 1022 | 1598.86 | 800.43 | 800.49 |
| 297 | Ac-LT4Pal$r8HYWAQL$S-NH2 | 1023 | 1598.86 | 800.43 | 800.49 |
| 298 | Ac-LTF2CF3$r8HYWAQL$S-NH2 | 1024 | 1665.85 | 833.93 | 834.01 |
| 299 | Ac-LTF2CN$r8HYWAQL$S-NH2 | 1025 | 1622.86 | 812.43 | 812.47 |
| 300 | Ac-LTF2Me$r8HYWAQL$S-NH2 | 1026 | 1611.88 | 806.94 | 807 |
| 301 | Ac-LTF3Cl$r8HYWAQL$S-NH2 | 1027 | 1631.83 | 816.92 | 816.99 |
| 302 | Ac-LTF4CF3$r8HYWAQL$S-NH2 | 1028 | 1665.85 | 833.93 | 833.94 |
| 303 | Ac-LTF4tBu$r8HYWAQL$S-NH2 | 1029 | 1653.93 | 827.97 | 828.02 |
| 304 | Ac-LTF5F$r8HYWAQL$S-NH2 | 1030 | 1687.82 | 844.91 | 844.96 |
| 305 | Ac-LTF$r8HY3BthAAQL$S-NH2 | 1031 | 1614.83 | 808.42 | 808.48 |
| 306 | Ac-LTF2Br$r8HYWAQL$S-NH2 | 1032 | 1675.78 | 838.89 | 838.97 |
| 307 | Ac-LTF4Br$r8HYWAQL$S-NH2 | 1033 | 1675.78 | 838.89 | 839.86 |
| 308 | Ac-LTF2Cl$r8HYWAQL$S-NH2 | 1034 | 1631.83 | 816.92 | 816.99 |
| 309 | Ac-LTF4Cl$r8HYWAQL$S-NH2 | 1035 | 1631.83 | 816.92 | 817.36 |
| 310 | Ac-LTF3CN$r8HYWAQL$S-NH2 | 1036 | 1622.86 | 812.43 | 812.47 |
| 311 | Ac-LTF4CN$r8HYWAQL$S-NH2 | 1037 | 1622.86 | 812.43 | 812.47 |
| 312 | Ac-LTF34Cl2$r8HYWAQL$S-NH2 | 1038 | 1665.79 | 833.90 | 833.94 |
| 313 | Ac-LTF34F2$r8HYWAQL$S-NH2 | 1039 | 1633.85 | 817.93 | 817.95 |
| 314 | Ac-LTF35F2$r8HYWAQL$S-NH2 | 1040 | 1633.85 | 817.93 | 817.95 |
| 315 | Ac-LTDip$r8HYWAQL$S-NH2 | 1041 | 1673.90 | 837.95 | 838.01 |
| 316 | Ac-LTF2F$r8HYWAQL$S-NH2 | 1042 | 1615.86 | 808.93 | 809 |
| 317 | Ac-LTF3F$r8HYWAQL$S-NH2 | 1043 | 1615.86 | 808.93 | 809 |
| 318 | Ac-LTF4F$r8HYWAQL$S-NH2 | 1044 | 1615.86 | 808.93 | 809 |
| 319 | Ac-LTF4I$r8HYWAQL$S-NH2 | 1045 | 1723.76 | 862.88 | 862.94 |
| 320 | Ac-LTF3Me$r8HYWAQL$S-NH2 | 1046 | 1611.88 | 806.94 | 807.07 |
| 321 | Ac-LTF4Me$r8HYWAQL$S-NH2 | 1047 | 1611.88 | 806.94 | 807 |
| 322 | Ac-LT1Nal$r8HYWAQL$S-NH2 | 1048 | 1647.88 | 824.94 | 824.98 |
| 323 | Ac-LT2Nal$r8HYWAQL$S-NH2 | 1049 | 1647.88 | 824.94 | 825.06 |
| 324 | Ac-LTF3CF3$r8HYWAQL$S-NH2 | 1050 | 1665.85 | 833.93 | 834.01 |
| 325 | Ac-LTF4NO2$r8HYWAQL$S-NH2 | 1051 | 1642.85 | 822.43 | 822.46 |
| 326 | Ac-LTF3NO2$r8HYWAQL$S-NH2 | 1052 | 1642.85 | 822.43 | 822.46 |
| 327 | Ac-LTF$r82ThiYWAQL$S-NH2 | 1053 | 1613.83 | 807.92 | 807.96 |
| 328 | Ac-LTF$r8HBipWAQL$S-NH2 | 1054 | 1657.90 | 829.95 | 830.01 |
| 329 | Ac-LTF$r8HF4tBuWAQL$S-NH2 | 1055 | 1637.93 | 819.97 | 820.02 |
| 330 | Ac-LTF$r8HF4CF3WAQL$S-NH2 | 1056 | 1649.86 | 825.93 | 826.02 |
| 331 | Ac-LTF$r8HF4ClWAQL$S-NH2 | 1057 | 1615.83 | 808.92 | 809.37 |
| 332 | Ac-LTF$r8HF4MeWAQL$S-NH2 | 1058 | 1595.89 | 798.95 | 799.01 |
| 333 | Ac-LTF$r8HF4BrWAQL$S-NH2 | 1059 | 1659.78 | 830.89 | 830.98 |
| 334 | Ac-LTF$r8HF4CNWAQL$S-NH2 | 1060 | 1606.87 | 804.44 | 804.56 |
| 335 | Ac-LTF$r8HF4NO2WAQL$S-NH2 | 1061 | 1626.86 | 814.43 | 814.55 |
| 336 | Ac-LTF$r8H1NalWAQL$S-NH2 | 1062 | 1631.89 | 816.95 | 817.06 |
| 337 | Ac-LTF$r8H2NalWAQL$S-NH2 | 1063 | 1631.89 | 816.95 | 816.99 |
| 338 | Ac-LTF$r8HWAQL$S-NH2 | 1064 | 1434.80 | 718.40 | 718.49 |
| 339 | Ac-LTF$r8HY1NalAQL$S-NH2 | 1065 | 1608.87 | 805.44 | 805.52 |
| 340 | Ac-LTF$r8HY2NalAQL$S-NH2 | 1066 | 1608.87 | 805.44 | 805.52 |
| 341 | Ac-LTF$r8HYWAQI$S-NH2 | 1067 | 1597.87 | 799.94 | 800.07 |
| 342 | Ac-LTF$r8HYWAQNle$S-NH2 | 1068 | 1597.87 | 799.94 | 800.44 |
| 343 | Ac-LTF$er8HYWAQL$eA-NH2 | 1069 | 1581.87 | 791.94 | 791.98 |
| 344 | Ac-LTF$r8HYWAQL$Abu-NH2 | 1070 | 1595.89 | 798.95 | 799.03 |
| 345 | Ac-LTF$r8HYWAbuQL$S-NH2 | 1071 | 1611.88 | 806.94 | 804.47 |
| 346 | Ac-LAF$r8HYWAQL$S-NH2 | 1072 | 1567.86 | 784.93 | 785.49 |
| 347 | Ac-LTF$r8NLWANleL$Q-NH2 | 1073 | 1550.92 | 776.46 | 777.5 |
| 348 | Ac-LTF$r8ALWANleL$Q-NH2 | 1074 | 1507.92 | 754.96 | 755.52 |
| 349 | Ac-LAF$r8NLWANleL$Q-NH2 | 1075 | 1520.91 | 761.46 | 762.48 |
| 350 | Ac-F$r8AYWAAc3cL$A-NH2 | 1076 | 1256.70 | 629.35 | 1257.56 |
| 351 | Ac-LTF$r8AYWAAL$S-NH2 | 1077 | 1474.82 | 738.41 | 738.55 |
| 352 | Ac-LVF$r8AYWAQL$S-NH2 | 1078 | 1529.87 | 765.94 | 766 |
| 353 | Ac-LTF$r8AYWAbuQL$S-NH2 | 1079 | 1545.86 | 773.93 | 773.92 |
| 354 | Ac-LTF$r8AYWNleQL$S-NH2 | 1080 | 1573.89 | 787.95 | 788.17 |
| 355 | Ac-LTF$r8AbuYWAQL$S-NH2 | 1081 | 1545.86 | 773.93 | 773.99 |
| 356 | Ac-LTF$r8AYWHQL$S-NH2 | 1082 | 1597.87 | 799.94 | 799.97 |
| 357 | Ac-LTF$r8AYWKQL$S-NH2 | 1083 | 1588.90 | 795.45 | 795.53 |
| 358 | Ac-LTF$r8AYWOQL$S-NH2 | 1084 | 1574.89 | 788.45 | 788.5 |

TABLE 4b-continued

| Number | Sequence | SEQ ID NO: | Exact Mass | M + 2 | Observed mass (m/e) |
|---|---|---|---|---|---|
| 359 | Ac-LTF$r8AYWRQL$S-NH2 | 1085 | 1616.91 | 809.46 | 809.51 |
| 360 | Ac-LTF$r8AYWSQL$S-NH2 | 1086 | 1547.84 | 774.92 | 774.96 |
| 361 | Ac-LTF$r8AYWRAL$S-NH2 | 1087 | 1559.89 | 780.95 | 780.95 |
| 362 | Ac-LTF$r8AYWRQL$A-NH2 | 1088 | 1600.91 | 801.46 | 801.52 |
| 363 | Ac-LTF$r8AYWRAL$A-NH2 | 1089 | 1543.89 | 772.95 | 773.03 |
| 364 | Ac-LTF$r5HYWAQL$s8S-NH2 | 1090 | 1597.87 | 799.94 | 799.97 |
| 365 | Ac-LTF$HYWAQL$r8S-NH2 | 1091 | 1597.87 | 799.94 | 799.97 |
| 366 | Ac-LTF$r8HYWAAL$S-NH2 | 1092 | 1540.84 | 771.42 | 771.48 |
| 367 | Ac-LTF$r8HYWAAbuL$S-NH2 | 1093 | 1554.86 | 778.43 | 778.51 |
| 368 | Ac-LTF$r8HYWALL$S-NH2 | 1094 | 1582.89 | 792.45 | 792.49 |
| 369 | Ac-F$r8AYWHAL$A-NH2 | 1095 | 1310.72 | 656.36 | 656.4 |
| 370 | Ac-F$r8AYWAAL$A-NH2 | 1096 | 1244.70 | 623.35 | 1245.61 |
| 371 | Ac-F$r8AYWSAL$A-NH2 | 1097 | 1260.69 | 631.35 | 1261.6 |
| 372 | Ac-F$r8AYWRAL$A-NH2 | 1098 | 1329.76 | 665.88 | 1330.72 |
| 373 | Ac-F$r8AYWKAL$A-NH2 | 1099 | 1301.75 | 651.88 | 1302.67 |
| 374 | Ac-F$r8AYWOAL$A-NH2 | 1100 | 1287.74 | 644.87 | 1289.13 |
| 375 | Ac-F$r8VYWEAc3cL$A-NH2 | 1101 | 1342.73 | 672.37 | 1343.67 |
| 376 | Ac-F$r8FYWEAc3cL$A-NH2 | 1102 | 1390.73 | 696.37 | 1392.14 |
| 377 | Ac-F$r8WYWEAc3cL$A-NH2 | 1103 | 1429.74 | 715.87 | 1431.44 |
| 378 | Ac-F$r8RYWEAc3cL$A-NH2 | 1104 | 1399.77 | 700.89 | 700.95 |
| 379 | Ac-F$r8KYWEAc3cL$A-NH2 | 1105 | 1371.76 | 686.88 | 686.97 |
| 380 | Ac-F$r8ANleWEAc3cL$A-NH2 | 1106 | 1264.72 | 633.36 | 1265.59 |
| 381 | Ac-F$r8AVWEAc3cL$A-NH2 | 1107 | 1250.71 | 626.36 | 1252.2 |
| 382 | Ac-F$r8AFWEAc3cL$A-NH2 | 1108 | 1298.71 | 650.36 | 1299.64 |
| 383 | Ac-F$r8AWWEAc3cL$A-NH2 | 1109 | 1337.72 | 669.86 | 1338.64 |
| 384 | Ac-F$r8ARWEAc3cL$A-NH2 | 1110 | 1307.74 | 654.87 | 655 |
| 385 | Ac-F$r8AKWEAc3cL$A-NH2 | 1111 | 1279.73 | 640.87 | 641.01 |
| 386 | Ac-F$r8AYWVAc3cL$A-NH2 | 1112 | 1284.73 | 643.37 | 643.38 |
| 387 | Ac-F$r8AYWFAc3cL$A-NH2 | 1113 | 1332.73 | 667.37 | 667.43 |
| 388 | Ac-F$r8AYWWAc3cL$A-NH2 | 1114 | 1371.74 | 686.87 | 686.97 |
| 389 | Ac-F$r8AYWRAc3cL$A-NH2 | 1115 | 1341.76 | 671.88 | 671.94 |
| 390 | Ac-F$r8AYWKAc3cL$A-NH2 | 1116 | 1313.75 | 657.88 | 657.88 |
| 391 | Ac-F$r8AYWEVL$A-NH2 | 1117 | 1330.73 | 666.37 | 666.47 |
| 392 | Ac-F$r8AYWEFL$A-NH2 | 1118 | 1378.73 | 690.37 | 690.44 |
| 393 | Ac-F$r8AYWEWL$A-NH2 | 1119 | 1417.74 | 709.87 | 709.91 |
| 394 | Ac-F$r8AYWERL$A-NH2 | 1120 | 1387.77 | 694.89 | 1388.66 |
| 395 | Ac-F$r8AYWEKL$A-NH2 | 1121 | 1359.76 | 680.88 | 1361.21 |
| 396 | Ac-F$r8AYWEAc3cL$V-NH2 | 1122 | 1342.73 | 672.37 | 1343.59 |
| 397 | Ac-F$r8AYWEAc3cL$F-NH2 | 1123 | 1390.73 | 696.37 | 1392.58 |
| 398 | Ac-F$r8AYWEAc3cL$W-NH2 | 1124 | 1429.74 | 715.87 | 1431.29 |
| 399 | Ac-F$r8AYWEAc3cL$R-NH2 | 1125 | 1399.77 | 700.89 | 700.95 |
| 400 | Ac-F$r8AYWEAc3cL$K-NH2 | 1126 | 1371.76 | 686.88 | 686.97 |
| 401 | Ac-F$r8AYWEAc3cL$AV-NH2 | 1127 | 1413.77 | 707.89 | 707.91 |
| 402 | Ac-F$r8AYWEAc3cL$AF-NH2 | 1128 | 1461.77 | 731.89 | 731.96 |
| 403 | Ac-F$r8AYWEAc3cL$AW-NH2 | 1129 | 1500.78 | 751.39 | 751.5 |
| 404 | Ac-F$r8AYWEAc3cL$AR-NH2 | 1130 | 1470.80 | 736.40 | 736.47 |
| 405 | Ac-F$r8AYWEAc3cL$AK-NH2 | 1131 | 1442.80 | 722.40 | 722.41 |
| 406 | Ac-F$r8AYWEAc3cL$AH-NH2 | 1132 | 1451.76 | 726.88 | 726.93 |
| 407 | Ac-LTF2NO2$r8HYWAQL$S-NH2 | 1133 | 1642.85 | 822.43 | 822.54 |
| 408 | Ac-LTA$r8HYAAQL$S-NH2 | 1134 | 1406.79 | 704.40 | 704.5 |
| 409 | Ac-LTF$r8HYAAQL$S-NH2 | 1135 | 1482.82 | 742.41 | 742.47 |
| 410 | Ac-QSQQTF$r8NLWALL$AN-NH2 | 1136 | 1966.07 | 984.04 | 984.38 |
| 411 | Ac-QAibQQTF$r8NLWALL$AN-NH2 | 1137 | 1964.09 | 983.05 | 983.42 |
| 412 | Ac-QAibQQTF$r8ALWALL$AN-NH2 | 1138 | 1921.08 | 961.54 | 961.59 |
| 413 | Ac-AAAATF$r8AAWAAL$AA-NH2 | 1139 | 1608.90 | 805.45 | 805.52 |
| 414 | Ac-F$r8AAWRAL$Q-NH2 | 1140 | 1294.76 | 648.38 | 648.48 |
| 415 | Ac-TF$r8AAWAAL$Q-NH2 | 1141 | 1310.74 | 656.37 | 1311.62 |
| 416 | Ac-TF$r8AAWRAL$A-NH2 | 1142 | 1338.78 | 670.39 | 670.46 |
| 417 | Ac-VF$r8AAWRAL$Q-NH2 | 1143 | 1393.82 | 697.91 | 697.99 |
| 418 | Ac-AF$r8AAWAAL$A-NH2 | 1144 | 1223.71 | 612.86 | 1224.67 |
| 420 | Ac-TF$r8AAWKAL$Q-NH2 | 1145 | 1367.80 | 684.90 | 684.97 |
| 421 | Ac-TF$r8AAWOAL$Q-NH2 | 1146 | 1353.78 | 677.89 | 678.01 |
| 422 | Ac-TF$r8AAWSAL$Q-NH2 | 1147 | 1326.73 | 664.37 | 664.47 |
| 423 | Ac-LTF$r8AAWRAL$Q-NH2 | 1148 | 1508.89 | 755.45 | 755.49 |
| 424 | Ac-F$r8AYWAQL$A-NH2 | 1149 | 1301.72 | 651.86 | 651.96 |
| 425 | Ac-F$r8AWWAAL$A-NH2 | 1150 | 1267.71 | 634.86 | 634.87 |
| 426 | Ac-F$r8AWWAQL$A-NH2 | 1151 | 1324.73 | 663.37 | 663.43 |
| 427 | Ac-F$r8AYWEAL$-NH2 | 1152 | 1231.66 | 616.83 | 1232.93 |
| 428 | Ac-F$r8AYWAAL$-NH2 | 1153 | 1173.66 | 587.83 | 1175.09 |
| 429 | Ac-F$r8AYWKAL$-NH2 | 1154 | 1230.72 | 616.36 | 616.44 |
| 430 | Ac-F$r8AYWOAL$-NH2 | 1155 | 1216.70 | 609.35 | 609.48 |
| 431 | Ac-F$r8AYWQAL$-NH2 | 1156 | 1230.68 | 616.34 | 616.44 |
| 432 | Ac-F$r8AYWAQL$-NH2 | 1157 | 1230.68 | 616.34 | 616.37 |
| 433 | Ac-F$r8HYWDQL$S-NH2 | 1158 | 1427.72 | 714.86 | 714.86 |
| 434 | Ac-F$r8HFWEQL$S-NH2 | 1159 | 1425.74 | 713.87 | 713.98 |
| 435 | Ac-F$r8AYWHQL$S-NH2 | 1160 | 1383.73 | 692.87 | 692.96 |
| 436 | Ac-F$r8AYWKQL$S-NH2 | 1161 | 1374.77 | 688.39 | 688.45 |

TABLE 4b-continued

| Number | Sequence | SEQ ID NO: | Exact Mass | M + 2 | Observed mass (m/e) |
|---|---|---|---|---|---|
| 437 | Ac-F$r8AYWOQL$S-NH2 | 1162 | 1360.75 | 681.38 | 681.49 |
| 438 | Ac-F$r8HYWSQL$S-NH2 | 1163 | 1399.73 | 700.87 | 700.95 |
| 439 | Ac-F$r8HWWEQL$S-NH2 | 1164 | 1464.76 | 733.38 | 733.44 |
| 440 | Ac-F$r8HWWAQL$S-NH2 | 1165 | 1406.75 | 704.38 | 704.43 |
| 441 | Ac-F$r8AWWHQL$S-NH2 | 1166 | 1406.75 | 704.38 | 704.43 |
| 442 | Ac-F$r8AWWKQL$S-NH2 | 1167 | 1397.79 | 699.90 | 699.92 |
| 443 | Ac-F$r8AWWOQL$S-NH2 | 1168 | 1383.77 | 692.89 | 692.96 |
| 444 | Ac-F$r8HWWSQL$S-NH2 | 1169 | 1422.75 | 712.38 | 712.42 |
| 445 | Ac-LTF$r8NYWANleL$Q-NH2 | 1170 | 1600.90 | 801.45 | 801.52 |
| 446 | Ac-LTF$r8NLWAQL$Q-NH2 | 1171 | 1565.90 | 783.95 | 784.06 |
| 447 | Ac-LTF$r8NYWANleL$A-NH2 | 1172 | 1543.88 | 772.94 | 773.03 |
| 448 | Ac-LTF$r8NLWAQL$A-NH2 | 1173 | 1508.88 | 755.44 | 755.49 |
| 449 | Ac-LTF$r8AYWANleL$Q-NH2 | 1174 | 1557.90 | 779.95 | 780.06 |
| 450 | Ac-LTF$r8ALWAQL$Q-NH2 | 1175 | 1522.89 | 762.45 | 762.45 |
| 451 | Ac-LAF$r8NYWANleL$Q-NH2 | 1176 | 1570.89 | 786.45 | 786.5 |
| 452 | Ac-LAF$r8NLWAQL$Q-NH2 | 1177 | 1535.89 | 768.95 | 769.03 |
| 453 | Ac-LAF$r8AYWANleL$A-NH2 | 1178 | 1470.86 | 736.43 | 736.47 |
| 454 | Ac-LAF$r8ALWAQL$A-NH2 | 1179 | 1435.86 | 718.93 | 719.01 |
| 455 | Ac-LAF$r8AYWAAL$A-NH2 | 1180 | 1428.82 | 715.41 | 715.41 |
| 456 | Ac-F$r8AYWEAc3cL$AAib-NH2 | 1181 | 1399.75 | 700.88 | 700.95 |
| 457 | Ac-F$r8AYWAQL$AA-NH2 | 1182 | 1372.75 | 687.38 | 687.78 |
| 458 | Ac-F$r8AYWAAc3cL$AA-NH2 | 1183 | 1327.73 | 664.87 | 664.84 |
| 459 | Ac-F$r8AYWSAc3cL$AA-NH2 | 1184 | 1343.73 | 672.87 | 672.9 |
| 460 | Ac-F$r8AYWEAc3cL$AS-NH2 | 1185 | 1401.73 | 701.87 | 701.84 |
| 461 | Ac-F$r8AYWEAc3cL$AT-NH2 | 1186 | 1415.75 | 708.88 | 708.87 |
| 462 | Ac-F$r8AYWEAc3cL$AL-NH2 | 1187 | 1427.79 | 714.90 | 714.94 |
| 463 | Ac-F$r8AYWEAc3cL$AQ-NH2 | 1188 | 1442.76 | 722.38 | 722.41 |
| 464 | Ac-F$r8AFWEAc3cL$AA-NH2 | 1189 | 1369.74 | 685.87 | 685.93 |
| 465 | Ac-F$r8AWWEAc3cL$AA-NH2 | 1190 | 1408.75 | 705.38 | 705.39 |
| 466 | Ac-F$r8AYWEAc3cL$SA-NH2 | 1191 | 1401.73 | 701.87 | 701.99 |
| 467 | Ac-F$r8AYWEAL$AA-NH2 | 1192 | 1373.74 | 687.87 | 687.93 |
| 468 | Ac-F$r8AYWENleL$AA-NH2 | 1193 | 1415.79 | 708.90 | 708.94 |
| 469 | Ac-F$r8AYWEAc3cL$AbuA-NH2 | 1194 | 1399.75 | 700.88 | 700.95 |
| 470 | Ac-F$r8AYWEAc3cL$NleA-NH2 | 1195 | 1427.79 | 714.90 | 714.86 |
| 471 | Ac-F$r8AYWEAibL$NleA-NH2 | 1196 | 1429.80 | 715.90 | 715.97 |
| 472 | Ac-F$r8AYWEAL$NleA-NH2 | 1197 | 1415.79 | 708.90 | 708.94 |
| 473 | Ac-F$r8AYWENleL$NleA-NH2 | 1198 | 1457.83 | 729.92 | 729.96 |
| 474 | Ac-F$r8AYWEAibL$Abu-NH2 | 1199 | 1330.73 | 666.37 | 666.39 |
| 475 | Ac-F$r8AYWENleL$Abu-NH2 | 1200 | 1358.76 | 680.38 | 680.39 |
| 476 | Ac-F$r8AYWEAL$Abu-NH2 | 1201 | 1316.72 | 659.36 | 659.36 |
| 477 | Ac-LTF$r8AFWAQL$S-NH2 | 1202 | 1515.85 | 758.93 | 759.12 |
| 478 | Ac-LTF$r8AWWAQL$S-NH2 | 1203 | 1554.86 | 778.43 | 778.51 |
| 479 | Ac-LTF$r8AYWAQI$S-NH2 | 1204 | 1531.84 | 766.92 | 766.96 |
| 480 | Ac-LTF$r8AYWAQNle$S-NH2 | 1205 | 1531.84 | 766.92 | 766.96 |
| 481 | Ac-LTF$r8AYWAQL$SA-NH2 | 1206 | 1602.88 | 802.44 | 802.48 |
| 482 | Ac-LTF$r8AWWAQL$A-NH2 | 1207 | 1538.87 | 770.44 | 770.89 |
| 483 | Ac-LTF$r8AYWAQI$A-NH2 | 1208 | 1515.85 | 758.93 | 759.42 |
| 484 | Ac-LTF$r8AYWAQNle$A-NH2 | 1209 | 1515.85 | 758.93 | 759.42 |
| 485 | Ac-LTF$r8AYWAQL$AA-NH2 | 1210 | 1586.89 | 794.45 | 794.94 |
| 486 | Ac-LTF$r8HWWAQL$S-NH2 | 1211 | 1620.88 | 811.44 | 811.47 |
| 487 | Ac-LTF$r8HRWAQL$S-NH2 | 1212 | 1590.90 | 796.45 | 796.52 |
| 488 | Ac-LTF$r8HKWAQL$S-NH2 | 1213 | 1562.90 | 782.45 | 782.53 |
| 489 | Ac-LTF$r8HYWAQL$W-NH2 | 1214 | 1696.91 | 849.46 | 849.5 |
| 491 | Ac-F$r8AYWAbuAL$A-NH2 | 1215 | 1258.71 | 630.36 | 630.5 |
| 492 | Ac-F$r8AbuYWEAL$A-NH2 | 1216 | 1316.72 | 659.36 | 659.51 |
| 493 | Ac-NlePRF%r8NYWRLL%QN-NH2 | 1217 | 1954.13 | 978.07 | 978.54 |
| 494 | Ac-TSF%r8HYWAQL%S-NH2 | 1218 | 1573.83 | 787.92 | 787.98 |
| 495 | Ac-LTF%r8AYWAQL%S-NH2 | 1219 | 1533.86 | 767.93 | 768 |
| 496 | Ac-HTF$r8HYWAQL$S-NH2 | 1220 | 1621.84 | 811.92 | 811.96 |
| 497 | Ac-LHF$r8HYWAQL$S-NH2 | 1221 | 1633.88 | 817.94 | 818.02 |
| 498 | Ac-LTF$r8HHWAQL$S-NH2 | 1222 | 1571.86 | 786.93 | 786.94 |
| 499 | Ac-LTF$r8HYWHQL$S-NH2 | 1223 | 1663.89 | 832.95 | 832.38 |
| 500 | Ac-LTF$r8HYWAHL$S-NH2 | 1224 | 1606.87 | 804.44 | 804.48 |
| 501 | Ac-LTF$r8HYWAQL$H-NH2 | 1225 | 1647.89 | 824.95 | 824.98 |
| 502 | Ac-LTF$r8HYWAQL$S-NHPr | 1226 | 1639.91 | 820.96 | 820.98 |
| 503 | Ac-LTF$r8HYWAQL$S-NHsBu | 1227 | 1653.93 | 827.97 | 828.02 |
| 504 | Ac-LTF$r8HYWAQL$S-NHiBu | 1228 | 1653.93 | 827.97 | 828.02 |
| 505 | Ac-LTF$r8HYWAQL$S-NHBn | 1229 | 1687.91 | 844.96 | 844.44 |
| 506 | Ac-LTF$r8HYWAQL$S-NHPe | 1230 | 1700.92 | 851.46 | 851.99 |
| 507 | Ac-LTF$r8HYWAQL$S-NHChx | 1231 | 1679.94 | 840.97 | 841.04 |
| 508 | Ac-ETF$r8AYWAQL$S-NH2 | 1232 | 1547.80 | 774.90 | 774.96 |
| 509 | Ac-STF$r8AYWAQL$S-NH2 | 1233 | 1505.79 | 753.90 | 753.94 |
| 510 | Ac-LEF$r8AYWAQL$S-NH2 | 1234 | 1559.84 | 780.92 | 781.25 |
| 511 | Ac-LSF$r8AYWAQL$S-NH2 | 1235 | 1517.83 | 759.92 | 759.93 |
| 512 | Ac-LTF$r8EYWAQL$S-NH2 | 1236 | 1589.85 | 795.93 | 795.97 |
| 513 | Ac-LTF$r8SYWAQL$S-NH2 | 1237 | 1547.84 | 774.92 | 774.96 |
| 514 | Ac-LTF$r8AYWEQL$S-NH2 | 1238 | 1589.85 | 795.93 | 795.9 |

TABLE 4b-continued

| Number | Sequence | SEQ ID NO: | Exact Mass | M + 2 | Observed mass (m/e) |
|---|---|---|---|---|---|
| 515 | Ac-LTF$r8AYWAEL$S-NH2 | 1239 | 1532.83 | 767.42 | 766.96 |
| 516 | Ac-LTF$r8AYWASL$S-NH2 | 1240 | 1490.82 | 746.41 | 746.46 |
| 517 | Ac-LTF$r8AYWAQL$E-NH2 | 1241 | 1573.85 | 787.93 | 787.98 |
| 518 | Ac-LTF2CN$r8HYWAQL$S-NH2 | 1242 | 1622.86 | 812.43 | 812.47 |
| 519 | Ac-LTF3Cl$r8HYWAQL$S-NH2 | 1243 | 1631.83 | 816.92 | 816.99 |
| 520 | Ac-LTDip$r8HYWAQL$S-NH2 | 1244 | 1673.90 | 837.95 | 838.01 |
| 521 | Ac-LTF$r8HYWAQTle$S-NH2 | 1245 | 1597.87 | 799.94 | 800.04 |
| 522 | Ac-F$r8AY6clWEAL$A-NH2 | 1246 | 1336.66 | 669.33 | 1338.56 |
| 523 | Ac-F$r8AYdl6brWEAL$A-NH2 | 1247 | 1380.61 | 691.31 | 692.2 |
| 524 | Ac-F$r8AYdl6fWEAL$A-NH2 | 1248 | 1320.69 | 661.35 | 1321.61 |
| 525 | Ac-F$r8AYdl4mWEAL$A-NH2 | 1249 | 1316.72 | 659.36 | 659.36 |
| 526 | Ac-F$r8AYdl5clWEAL$A-NH2 | 1250 | 1336.66 | 669.33 | 669.35 |
| 527 | Ac-F$r8AYdl7mWEAL$A-NH2 | 1251 | 1316.72 | 659.36 | 659.36 |
| 528 | Ac-LTF%r8HYWAQL%A-NH2 | 1252 | 1583.89 | 792.95 | 793.01 |
| 529 | Ac-LTF$r8HCouWAQL$S-NH2 | 1253 | 1679.87 | 840.94 | 841.38 |
| 530 | Ac-LTFEHCouWAQLTS-NH2 | 1254 | 1617.75 | 809.88 | 809.96 |
| 531 | Ac-LTA$r8HCouWAQL$S-NH2 | 1255 | 1603.84 | 802.92 | 803.36 |
| 532 | Ac-F$r8AYWEAL$AbuA-NH2 | 1256 | 1387.75 | 694.88 | 694.88 |
| 533 | Ac-F$r8AYWEAI$AA-NH2 | 1257 | 1373.74 | 687.87 | 687.93 |
| 534 | Ac-F$r8AYWEANle$AA-NH2 | 1258 | 1373.74 | 687.87 | 687.93 |
| 535 | Ac-F$r8AYWEAmlL$AA-NH2 | 1259 | 1429.80 | 715.90 | 715.97 |
| 536 | Ac-F$r8AYWQAL$AA-NH2 | 1260 | 1372.75 | 687.38 | 687.48 |
| 537 | Ac-F$r8AYWAAL$AA-NH2 | 1261 | 1315.73 | 658.87 | 658.92 |
| 538 | Ac-F$r8AYWAbuAL$AA-NH2 | 1262 | 1329.75 | 665.88 | 665.95 |
| 539 | Ac-F$r8AYWNleAL$AA-NH2 | 1263 | 1357.78 | 679.89 | 679.94 |
| 540 | Ac-F$r8AbuYWEAL$AA-NH2 | 1264 | 1387.75 | 694.88 | 694.88 |
| 541 | Ac-F$r8NleYWEAL$AA-NH2 | 1265 | 1415.79 | 708.90 | 708.94 |
| 542 | Ac-F$r8FYWEAL$AA-NH2 | 1266 | 1449.77 | 725.89 | 725.97 |
| 543 | Ac-LTF$r8HYWAQhL$S-NH2 | 1267 | 1611.88 | 806.94 | 807 |
| 544 | Ac-LTF$r8HYWAQAdm$S-NH2 | 1268 | 1675.91 | 838.96 | 839.04 |
| 545 | Ac-LTF$r8HYWAQIgl$S-NH2 | 1269 | 1659.88 | 830.94 | 829.94 |
| 546 | Ac-F$r8AYWAQL$AA-NH2 | 1270 | 1372.75 | 687.38 | 687.48 |
| 547 | Ac-LTF$r8ALWAQL$Q-NH2 | 1271 | 1522.89 | 762.45 | 762.52 |
| 548 | Ac-F$r8AYWEAL$AA-NH2 | 1272 | 1373.74 | 687.87 | 687.93 |
| 549 | Ac-F$r8AYWENleL$AA-NH2 | 1273 | 1415.79 | 708.90 | 708.94 |
| 550 | Ac-F$r8AYWEAibL$Abu-NH2 | 1274 | 1330.73 | 666.37 | 666.39 |
| 551 | Ac-F$r8AYWENleL$Abu-NH2 | 1275 | 1358.76 | 680.38 | 680.38 |
| 552 | Ac-F$r8AYWEAL$Abu-NH2 | 1276 | 1316.72 | 659.36 | 659.36 |
| 553 | Ac-F$r8AYWEAc3cL$AbuA-NH2 | 1277 | 1399.75 | 700.88 | 700.95 |
| 554 | Ac-F$r8AYWEAc3cL$NleA-NH2 | 1278 | 1427.79 | 714.90 | 715.01 |
| 555 | H-LTF$r8AYWAQL$S-NH2 | 1279 | 1489.83 | 745.92 | 745.95 |
| 556 | mdPEG3-LTF$r8AYWAQL$S-NH2 | 1280 | 1679.92 | 840.96 | 840.97 |
| 557 | mdPEG7-LTF$r8AYWAQL$S-NH2 | 1281 | 1856.02 | 929.01 | 929.03 |
| 558 | Ac-F$r8ApmpEt6clWEAL$A-NH2 | 1282 | 1470.71 | 736.36 | 788.17 |
| 559 | Ac-LTF3Cl$r8AYWAQL$S-NH2 | 1283 | 1565.81 | 783.91 | 809.18 |
| 560 | Ac-LTF3Cl$r8AYWAQL$A-NH2 | 1284 | 1615.83 | 808.92 | 875.24 |
| 561 | Ac-LTF3Cl$r8HYWWQL$S-NH2 | 1285 | 1746.87 | 874.44 | 841.65 |
| 562 | Ac-LTF3Cl$r8AYWWQL$S-NH2 | 1286 | 1680.85 | 841.43 | 824.63 |
| 563 | Ac-LTF$r8AYWWQL$S-NH2 | 1287 | 1646.89 | 824.45 | 849.98 |
| 564 | Ac-LTF$r8HYWWQL$A-NH2 | 1288 | 1696.91 | 849.46 | 816.67 |
| 565 | Ac-LTF$r8AYWWQL$A-NH2 | 1289 | 1630.89 | 816.45 | 776.15 |
| 566 | Ac-LTF4F$r8AYWAQL$S-NH2 | 1290 | 1549.83 | 775.92 | 776.15 |
| 567 | Ac-LTF2F$r8AYWAQL$S-NH2 | 1291 | 1549.83 | 775.92 | 776.15 |
| 568 | Ac-LTF3F$r8AYWAQL$S-NH2 | 1292 | 1549.83 | 775.92 | 785.12 |
| 569 | Ac-LTF34F2$r8AYWAQL$S-NH2 | 1293 | 1567.83 | 784.92 | 785.12 |
| 570 | Ac-LTF35F2$r8AYWAQL$S-NH2 | 1294 | 1567.83 | 784.92 | 1338.74 |
| 571 | Ac-F3Cl$r8AYWEAL$A-NH2 | 1295 | 1336.66 | 669.33 | 705.28 |
| 572 | Ac-F3Cl$r8AYWEAL$AA-NH2 | 1296 | 1407.70 | 704.85 | 680.11 |
| 573 | Ac-F$r8AY6clWEAL$AA-NH2 | 1297 | 1407.70 | 704.85 | 736.83 |
| 574 | Ac-F$r8AY6clWEAL$-NH2 | 1298 | 1265.63 | 633.82 | 784.1 |
| 575 | Ac-LTF$r8HYWAQLSt/S-NH2 | 1299 | 16.03 | 9.02 | 826.98 |
| 576 | Ac-LTF$r8HYWAQL$S-NHsBu | 1300 | 1653.93 | 827.97 | 828.02 |
| 577 | Ac-STF$r8AYWAQL$S-NH2 | 1301 | 1505.79 | 753.90 | 753.94 |
| 578 | Ac-LTF$r8AYWAEL$S-NH2 | 1302 | 1532.83 | 767.42 | 767.41 |
| 579 | Ac-LTF$r8AYWAQL$E-NH2 | 1303 | 1573.85 | 787.93 | 787.98 |
| 580 | mdPEG3-LTF$r8AYWAQL$S-NH2 | 1304 | 1679.92 | 840.96 | 840.97 |
| 581 | Ac-LTF$r8AYWAQhL$S-NH2 | 1305 | 1545.86 | 773.93 | 774.31 |
| 583 | Ac-LTF$r8AYWAQCha$S-NH2 | 1306 | 1571.88 | 786.94 | 787.3 |
| 584 | Ac-LTF$r8AYWAQChg$S-NH2 | 1307 | 1557.86 | 779.93 | 780.4 |
| 585 | Ac-LTF$r8AYWAQCba$S-NH2 | 1308 | 1543.84 | 772.92 | 780.13 |
| 586 | Ac-LTF$r8AYWAQF$S-NH2 | 1309 | 1565.83 | 783.92 | 784.2 |
| 587 | Ac-LTF4F$r8HYWAQhL$S-NH2 | 1310 | 1629.87 | 815.94 | 815.36 |
| 588 | Ac-LTF4F$r8HYWAQCha$S-NH2 | 1311 | 1655.89 | 828.95 | 828.39 |
| 589 | Ac-LTF4F$r8HYWAQChg$S-NH2 | 1312 | 1641.87 | 821.94 | 821.35 |
| 590 | Ac-LTF4F$r8HYWAQCba$S-NH2 | 1313 | 1627.86 | 814.93 | 814.32 |
| 591 | Ac-LTF4F$r8AYWAQhL$S-NH2 | 1314 | 1563.85 | 782.93 | 782.36 |
| 592 | Ac-LTF4F$r8AYWAQCha$S-NH2 | 1315 | 1589.87 | 795.94 | 795.38 |

TABLE 4b-continued

| Number | Sequence | SEQ ID NO: | Exact Mass | M + 2 | Observed mass (m/e) |
|---|---|---|---|---|---|
| 593 | Ac-LTF4F$r8AYWAQChg$S-NH2 | 1316 | 1575.85 | 788.93 | 788.35 |
| 594 | Ac-LTF4F$r8AYWAQCba$S-NH2 | 1317 | 1561.83 | 781.92 | 781.39 |
| 595 | Ac-LTF3Cl$r8AYWAQhL$S-NH2 | 1318 | 1579.82 | 790.91 | 790.35 |
| 596 | Ac-LTF3Cl$r8AYWAQCha$S-NH2 | 1319 | 1605.84 | 803.92 | 803.67 |
| 597 | Ac-LTF3Cl$r8AYWAQChg$S-NH2 | 1320 | 1591.82 | 796.91 | 796.34 |
| 598 | Ac-LTF3Cl$r8AYWAQCba$S-NH2 | 1321 | 1577.81 | 789.91 | 789.39 |
| 599 | Ac-LTF$r8AYWAQhF$S-NH2 | 1322 | 1579.84 | 790.92 | 791.14 |
| 600 | Ac-LTF$r8AYWAQF3CF3$S-NH2 | 1323 | 1633.82 | 817.91 | 818.15 |
| 601 | Ac-LTF$r8AYWAQF3Me$S-NH2 | 1324 | 1581.86 | 791.93 | 791.32 |
| 602 | Ac-LTF$r8AYWAQ1Nal$S-NH2 | 1325 | 1615.84 | 808.92 | 809.18 |
| 603 | Ac-LTF$r8AYWAQBip$S-NH2 | 1326 | 1641.86 | 821.93 | 822.13 |
| 604 | Ac-LTF$r8FYWAQL$A-NH2 | 1327 | 1591.88 | 796.94 | 797.33 |
| 605 | Ac-LTF$r8HYWAQL$S-NHAm | 1328 | 1667.94 | 834.97 | 835.92 |
| 606 | Ac-LTF$r8HYWAQL$S-NHiAm | 1329 | 1667.94 | 834.97 | 835.55 |
| 607 | Ac-LTF$r8HYWAQL$S-NHnPr3Ph | 1330 | 1715.94 | 858.97 | 859.79 |
| 608 | Ac-LTF$r8HYWAQL$S-NHnBu3,3Me | 1331 | 1681.96 | 841.98 | 842.49 |
| 610 | Ac-LTF$r8HYWAQL$S-NHnPr | 1332 | 1639.91 | 820.96 | 821.58 |
| 611 | Ac-LTF$r8HYWAQL$S-NHnEt2Ch | 1333 | 1707.98 | 854.99 | 855.35 |
| 612 | Ac-LTF$r8HYWAQL$S-NHHex | 1334 | 1681.96 | 841.98 | 842.4 |
| 613 | Ac-LTF$r8AYWAQL$S-NHmdPeg2 | 1335 | 1633.91 | 817.96 | 818.35 |
| 614 | Ac-LTF$r8AYWAQL$A-NHmdPeg2 | 1336 | 1617.92 | 809.96 | 810.3 |
| 615 | Ac-LTF$r8AYWAQL$A-NHmdPeg4 | 1337 | 1705.97 | 853.99 | 854.33 |
| 616 | Ac-F$r8AYdl4mWEAL$A-NH2 | 1338 | 1316.72 | 659.36 | 659.44 |
| 617 | Ac-F$r8AYdl5clWEAL$A-NH2 | 1339 | 1336.66 | 669.33 | 669.43 |
| 618 | Ac-LThF$r8AYWAQL$S-NH2 | 1340 | 1545.86 | 773.93 | 774.11 |
| 619 | Ac-LT2Nal$r8AYWAQL$S-NH2 | 1341 | 1581.86 | 791.93 | 792.43 |
| 620 | Ac-LTA$r8AYWAQL$S-NH2 | 1342 | 1455.81 | 728.91 | 729.15 |
| 621 | Ac-LTF$r8AYWVQL$S-NH2 | 1343 | 1559.88 | 780.94 | 781.24 |
| 622 | Ac-LTF$r8HYWAAL$A-NH2 | 1344 | 1524.85 | 763.43 | 763.86 |
| 623 | Ac-LTF$r8VYWAQL$A-NH2 | 1345 | 1543.88 | 772.94 | 773.37 |
| 624 | Ac-LTF$r8IYWAQL$S-NH2 | 1346 | 1573.89 | 787.95 | 788.17 |
| 625 | Ac-FTF$r8VYWSQL$S-NH2 | 1347 | 1609.85 | 805.93 | 806.22 |
| 626 | Ac-ITF$r8FYWAQL$S-NH2 | 1348 | 1607.88 | 804.94 | 805.2 |
| 627 | Ac-2NalTF$r8VYWSQL$S-NH2 | 1349 | 1659.87 | 830.94 | 831.2 |
| 628 | Ac-ITF$r8LYWSQL$S-NH2 | 1350 | 1589.89 | 795.95 | 796.13 |
| 629 | Ac-FTF$r8FYWAQL$S-NH2 | 1351 | 1641.86 | 821.93 | 822.13 |
| 630 | Ac-WTF$r8VYWAQL$S-NH2 | 1352 | 1632.87 | 817.44 | 817.69 |
| 631 | Ac-WTF$r8WYWAQL$S-NH2 | 1353 | 1719.88 | 860.94 | 861.36 |
| 632 | Ac-VTF$r8AYWAQL$S-NH2 | 1354 | 1533.82 | 767.91 | 768.19 |
| 633 | Ac-WTF$r8FYWSQL$S-NH2 | 1355 | 1696.87 | 849.44 | 849.7 |
| 634 | Ac-FTF$r8IYWAQL$S-NH2 | 1356 | 1607.88 | 804.94 | 805.2 |
| 635 | Ac-WTF$r8VYWSQL$S-NH2 | 1357 | 1648.87 | 825.44 | 824.8 |
| 636 | Ac-FTF$r8LYWSQL$S-NH2 | 1358 | 1623.87 | 812.94 | 812.8 |
| 637 | Ac-YTF$r8FYWSQL$S-NH2 | 1359 | 1673.85 | 837.93 | 837.8 |
| 638 | Ac-LTF$r8AY6clWEAL$A-NH2 | 1360 | 1550.79 | 776.40 | 776.14 |
| 639 | Ac-LTF$r8AY6clWSQL$S-NH2 | 1361 | 1581.80 | 791.90 | 791.68 |
| 640 | Ac-F$r8AY6clWSAL$A-NH2 | 1362 | 1294.65 | 648.33 | 647.67 |
| 641 | Ac-F$r8AY6clWQAL$AA-NH2 | 1363 | 1406.72 | 704.36 | 703.84 |
| 642 | Ac-LHF$r8AYWAQL$S-NH2 | 1364 | 1567.86 | 784.93 | 785.21 |
| 643 | Ac-LTF$r8AYWAQL$S-NH2 | 1365 | 1531.84 | 766.92 | 767.17 |
| 644 | Ac-LTF$r8AHWAQL$S-NH2 | 1366 | 1505.84 | 753.92 | 754.13 |
| 645 | Ac-LTF$r8AYWAHL$S-NH2 | 1367 | 1540.84 | 771.42 | 771.61 |
| 646 | Ac-LTF$r8AYWAQL$H-NH2 | 1368 | 1581.87 | 791.94 | 792.15 |
| 647 | H-LTF$r8AYWAQL$A-NH2 | 1369 | 1473.84 | 737.92 | 737.29 |
| 648 | Ac-HHF$r8AYWAQL$S-NH2 | 1370 | 1591.83 | 796.92 | 797.35 |
| 649 | Ac-aAibWTF$r8VYWSQL$S-NH2 | 1371 | 1804.96 | 903.48 | 903.64 |
| 650 | Ac-AibWTF$r8HYWAQL$S-NH2 | 1372 | 1755.91 | 878.96 | 879.4 |
| 651 | Ac-AibAWTF$r8HYWAQL$S-NH2 | 1373 | 1826.95 | 914.48 | 914.7 |
| 652 | Ac-fWTF$r8HYWAQL$S-NH2 | 1374 | 1817.93 | 909.97 | 910.1 |
| 653 | Ac-AibWWTF$r8HYWAQL$S-NH2 | 1375 | 1941.99 | 972.00 | 972.2 |
| 654 | Ac-WTF$r8LYWSQL$S-NH2 | 1376 | 1662.88 | 832.44 | 832.8 |
| 655 | Ac-WTF$r8NleYWSQL$S-NH2 | 1377 | 1662.88 | 832.44 | 832.6 |
| 656 | Ac-LTF$r8AYWSQL$a-NH2 | 1378 | 1531.84 | 766.92 | 767.2 |
| 657 | Ac-LTF$r8EYWARL$A-NH2 | 1379 | 1601.90 | 801.95 | 802.1 |
| 658 | Ac-LTF$r8EYWAHL$A-NH2 | 1380 | 1582.86 | 792.43 | 792.6 |
| 659 | Ac-aTF$r8AYWAQL$S-NH2 | 1381 | 1489.80 | 745.90 | 746.08 |
| 660 | Ac-AibTF$r8AYWAQL$S-NH2 | 1382 | 1503.81 | 752.91 | 753.11 |
| 661 | Ac-AmfTF$r8AYWAQL$S-NH2 | 1383 | 1579.84 | 790.92 | 791.14 |
| 662 | Ac-AmwTF$r8AYWAQL$S-NH2 | 1384 | 1618.86 | 810.43 | 810.66 |
| 663 | Ac-NmLTF$r8AYWAQL$S-NH2 | 1385 | 1545.86 | 773.93 | 774.11 |
| 664 | Ac-LNmTF$r8AYWAQL$S-NH2 | 1386 | 1545.86 | 773.93 | 774.11 |
| 665 | Ac-LSarF$r8AYWAQL$S-NH2 | 1387 | 1501.83 | 751.92 | 752.18 |
| 667 | Ac-LGF$r8AYWAQL$S-NH2 | 1388 | 1487.82 | 744.91 | 745.15 |
| 668 | Ac-LTNmF$r8AYWAQL$S-NH2 | 1389 | 1545.86 | 773.93 | 774.2 |
| 669 | Ac-TF$r8AYWAQL$S-NH2 | 1390 | 1418.76 | 710.38 | 710.64 |
| 670 | Ac-ETF$r8AYWAQL$A-NH2 | 1391 | 1531.81 | 766.91 | 767.2 |
| 671 | Ac-LTF$r8EYWAQL$A-NH2 | 1392 | 1573.85 | 787.93 | 788.1 |

TABLE 4b-continued

| Number | Sequence | SEQ ID NO: | Exact Mass | M + 2 | Observed mass (m/e) |
|---|---|---|---|---|---|
| 672 | Ac-LT2Nal$r8AYWSQL$S-NH2 | 1393 | 1597.85 | 799.93 | 800.4 |
| 673 | Ac-LTF$r8AYWAAL$S-NH2 | 1394 | 1474.82 | 738.41 | 738.68 |
| 674 | Ac-LTF$r8AYWAQhCha$S-NH2 | 1395 | 1585.89 | 793.95 | 794.19 |
| 675 | Ac-LTF$r8AYWAQChg$S-NH2 | 1396 | 1557.86 | 779.93 | 780.97 |
| 676 | Ac-LTF$r8AYWAQCba$S-NH2 | 1397 | 1543.84 | 772.92 | 773.19 |
| 677 | Ac-LTF$r8AYWAQF3CF3$S-NH2 | 1398 | 1633.82 | 817.91 | 818.15 |
| 678 | Ac-LTF$r8AYWAQ1Nal$S-NH2 | 1399 | 1615.84 | 808.92 | 809.18 |
| 679 | Ac-LTF$r8AYWAQBip$S-NH2 | 1400 | 1641.86 | 821.93 | 822.32 |
| 680 | Ac-LT2Nal$r8AYWAQL$S-NH2 | 1401 | 1581.86 | 791.93 | 792.15 |
| 681 | Ac-LTF$r8AYWVQL$S-NH2 | 1402 | 1559.88 | 780.94 | 781.62 |
| 682 | Ac-LTF$r8AWWAQL$S-NH2 | 1403 | 1554.86 | 778.43 | 778.65 |
| 683 | Ac-FTF$r8VYWSQL$S-NH2 | 1404 | 1609.85 | 805.93 | 806.12 |
| 684 | Ac-ITF$r8FYWAQL$S-NH2 | 1405 | 1607.88 | 804.94 | 805.2 |
| 685 | Ac-ITF$r8LYWSQL$S-NH2 | 1406 | 1589.89 | 795.95 | 796.22 |
| 686 | Ac-FTF$r8FYWAQL$S-NH2 | 1407 | 1641.86 | 821.93 | 822.41 |
| 687 | Ac-VTF$r8AYWSQL$S-NH2 | 1408 | 1533.82 | 767.91 | 768.19 |
| 688 | Ac-LTF$r8AHWAQL$S-NH2 | 1409 | 1505.84 | 753.92 | 754.31 |
| 689 | Ac-LTF$r8AYWAQL$H-NH2 | 1410 | 1581.87 | 791.94 | 791.94 |
| 690 | Ac-LTF$r8AYWAHL$S-NH2 | 1411 | 1540.84 | 771.42 | 771.61 |
| 691 | Ac-aAibWTF$r8VYWSQL$S-NH2 | 1412 | 1804.96 | 903.48 | 903.9 |
| 692 | Ac-AibWTF$r8HYWAQL$S-NH2 | 1413 | 1755.91 | 878.96 | 879.5 |
| 693 | Ac-AibAWTF$r8HYWAQL$S-NH2 | 1414 | 1826.95 | 914.48 | 914.7 |
| 694 | Ac-fWTF$r8HYWAQL$S-NH2 | 1415 | 1817.93 | 909.97 | 910.2 |
| 695 | Ac-AibWWTF$r8HYWAQL$S-NH2 | 1416 | 1941.99 | 972.00 | 972.7 |
| 696 | Ac-WTF$r8LYWSQL$S-NH2 | 1417 | 1662.88 | 832.44 | 832.7 |
| 697 | Ac-WTF$r8NleYWSQL$S-NH2 | 1418 | 1662.88 | 832.44 | 832.7 |
| 698 | Ac-LTF$r8AYWSQL$a-NH2 | 1419 | 1531.84 | 766.92 | 767.2 |
| 699 | Ac-LTF$r8EYWARL$A-NH2 | 1420 | 1601.90 | 801.95 | 802.2 |
| 700 | Ac-LTF$r8EYWAHL$A-NH2 | 1421 | 1582.86 | 792.43 | 792.6 |
| 701 | Ac-aTF$r8AYWAQL$S-NH2 | 1422 | 1489.80 | 745.90 | 746.1 |
| 702 | Ac-AibTF$r8AYWAQL$S-NH2 | 1423 | 1503.81 | 752.91 | 753.2 |
| 703 | Ac-AmfTF$r8AYWAQL$S-NH2 | 1424 | 1579.84 | 790.92 | 791.2 |
| 704 | Ac-AmwTF$r8AYWAQL$S-NH2 | 1425 | 1618.86 | 810.43 | 810.7 |
| 705 | Ac-NmLTF$r8AYWAQL$S-NH2 | 1426 | 1545.86 | 773.93 | 774.1 |
| 706 | Ac-LNmTF$r8AYWAQL$S-NH2 | 1427 | 1545.86 | 773.93 | 774.4 |
| 707 | Ac-LSarF$r8AYWAQL$S-NH2 | 1428 | 1501.83 | 751.92 | 752.1 |
| 708 | Ac-TF$r8AYWAQL$S-NH2 | 1429 | 1418.76 | 710.38 | 710.8 |
| 709 | Ac-ETF$r8AYWAQL$A-NH2 | 1430 | 1531.81 | 766.91 | 767.4 |
| 710 | Ac-LTF$r8EYWAQL$A-NH2 | 1431 | 1573.85 | 787.93 | 788.2 |
| 711 | Ac-WTF$r8VYWSQL$S-NH2 | 1432 | 1648.87 | 825.44 | 825.2 |
| 713 | Ac-YTF$r8FYWSQL$S-NH2 | 1433 | 1673.85 | 837.93 | 837.3 |
| 714 | Ac-F$r8AY6clWSAL$A-NH2 | 1434 | 1294.65 | 648.33 | 647.74 |
| 715 | Ac-ETF$r8EYWVQL$S-NH2 | 1435 | 1633.84 | 817.92 | 817.36 |
| 716 | Ac-ETF$r8EHWAQL$A-NH2 | 1436 | 1563.81 | 782.91 | 782.36 |
| 717 | Ac-ITF$r8EYWAQL$S-NH2 | 1437 | 1589.85 | 795.93 | 795.38 |
| 718 | Ac-ITF$r8EHWVQL$A-NH2 | 1438 | 1575.88 | 788.94 | 788.42 |
| 719 | Ac-ITF$r8EHWAQL$S-NH2 | 1439 | 1563.85 | 782.93 | 782.43 |
| 720 | Ac-LTF4F$r8AYWAQCba$S-NH2 | 1440 | 1561.83 | 781.92 | 781.32 |
| 721 | Ac-LTF3Cl$r8AYWAQhL$S-NH2 | 1441 | 1579.82 | 790.91 | 790.64 |
| 722 | Ac-LTF3Cl$r8AYWAQCha$S-NH2 | 1442 | 1605.84 | 803.92 | 803.37 |
| 723 | Ac-LTF3Cl$r8AYWAQChg$S-NH2 | 1443 | 1591.82 | 796.91 | 796.27 |
| 724 | Ac-LTF3Cl$r8AYWAQCba$S-NH2 | 1444 | 1577.81 | 789.91 | 789.83 |
| 725 | Ac-LTF$r8AY6clWSQL$S-NH2 | 1445 | 1581.80 | 791.90 | 791.75 |
| 726 | Ac-LTF4F$r8HYWAQhL$S-NH2 | 1446 | 1629.87 | 815.94 | 815.36 |
| 727 | Ac-LTF4F$r8HYWAQCba$S-NH2 | 1447 | 1627.86 | 814.93 | 814.32 |
| 728 | Ac-LTF4F$r8AYWAQhL$S-NH2 | 1448 | 1563.85 | 782.93 | 782.36 |
| 729 | Ac-LTF4F$r8AYWAQChg$S-NH2 | 1449 | 1575.85 | 788.93 | 788.35 |
| 730 | Ac-ETF$r8EYWVAL$S-NH2 | 1450 | 1576.82 | 789.41 | 788.79 |
| 731 | Ac-ETF$r8EHWAAL$A-NH2 | 1451 | 1506.79 | 754.40 | 754.8 |
| 732 | Ac-ITF$r8EYWAAL$S-NH2 | 1452 | 1532.83 | 767.42 | 767.75 |
| 733 | Ac-ITF$r8EHWVAL$A-NH2 | 1453 | 1518.86 | 760.43 | 760.81 |
| 734 | Ac-ITF$r8EHWAAL$S-NH2 | 1454 | 1506.82 | 754.41 | 754.8 |
| 735 | Pam-LTF$r8EYWAQL$S-NH2 | 1455 | 1786.07 | 894.04 | 894.48 |
| 736 | Pam-ETF$r8EYWAQL$S-NH2 | 1456 | 1802.03 | 902.02 | 902.34 |
| 737 | Ac-LTF$r8AYWLQL$S-NH2 | 1457 | 1573.89 | 787.95 | 787.39 |
| 738 | Ac-LTF$r8EYWLQL$S-NH2 | 1458 | 1631.90 | 816.95 | 817.33 |
| 739 | Ac-LTF$r8EHWLQL$S-NH2 | 1459 | 1605.89 | 803.95 | 804.29 |
| 740 | Ac-LTF$r8VYWAQL$S-NH2 | 1460 | 1559.88 | 780.94 | 781.34 |
| 741 | Ac-LTF$r8AYWSQL$S-NH2 | 1461 | 1547.84 | 774.92 | 775.33 |
| 742 | Ac-ETF$r8AYWAQL$S-NH2 | 1462 | 1547.80 | 774.90 | 775.7 |
| 743 | Ac-LTF$r8EYWAQL$S-NH2 | 1463 | 1589.85 | 795.93 | 796.33 |
| 744 | Ac-LTF$r8HYWAQL$S-NHAm | 1464 | 1667.94 | 834.97 | 835.37 |
| 745 | Ac-LTF$r8HYWAQL$S-NHiAm | 1465 | 1667.94 | 834.97 | 835.27 |
| 746 | Ac-LTF$r8HYWAQL$S-NHnPr3Ph | 1466 | 1715.94 | 858.97 | 859.42 |
| 747 | Ac-LTF$r8HYWAQL$S-NHnBu3,3Me | 1467 | 1681.96 | 841.98 | 842.67 |
| 748 | Ac-LTF$r8HYWAQL$S-NHnBu | 1468 | 1653.93 | 827.97 | 828.24 |
| 749 | Ac-LTF$r8HYWAQL$S-NHnPr | 1469 | 1639.91 | 820.96 | 821.31 |

TABLE 4b-continued

| Number | Sequence | SEQ ID NO: | Exact Mass | M + 2 | Observed mass (m/e) |
|---|---|---|---|---|---|
| 750 | Ac-LTF$r8HYWAQL$S-NHnEt2Ch | 1470 | 1707.98 | 854.99 | 855.35 |
| 751 | Ac-LTF$r8HYWAQL$S-NHHex | 1471 | 1681.96 | 841.98 | 842.4 |
| 752 | Ac-LTF$r8AYWAQL$S-NHmdPeg2 | 1472 | 1633.91 | 817.96 | 855.35 |
| 753 | Ac-LTF$r8AYWAQL$A-NHmdPeg2 | 1473 | 1617.92 | 809.96 | 810.58 |
| 754 | Ac-LTF$r5AYWAAL$s8S-NH2 | 1474 | 1474.82 | 738.41 | 738.79 |
| 755 | Ac-LTF$r8AYWCouQL$S-NH2 | 1475 | 1705.88 | 853.94 | 854.61 |
| 756 | Ac-LTF$r8CouYWAQL$S-NH2 | 1476 | 1705.88 | 853.94 | 854.7 |
| 757 | Ac-CouTF$r8AYWAQL$S-NH2 | 1477 | 1663.83 | 832.92 | 833.33 |
| 758 | H-LTF$r8AYWAQL$A-NH2 | 1478 | 1473.84 | 737.92 | 737.29 |
| 759 | Ac-HHF$r8AYWAQL$S-NH2 | 1479 | 1591.83 | 796.92 | 797.72 |
| 760 | Ac-LT2Nal$r8AYWSQL$S-NH2 | 1480 | 1597.85 | 799.93 | 800.68 |
| 761 | Ac-LTF$r8HCouWAQL$S-NH2 | 1481 | 1679.87 | 840.94 | 841.38 |
| 762 | Ac-LTF$r8AYWCou2QL$S-NH2 | 1482 | 1789.94 | 895.97 | 896.51 |
| 763 | Ac-LTF$r8Cou2YWAQL$S-NH2 | 1483 | 1789.94 | 895.97 | 896.5 |
| 764 | Ac-Cou2TF$r8AYWAQL$S-NH2 | 1484 | 1747.90 | 874.95 | 875.42 |
| 765 | Ac-LTF$r8ACou2WAQL$S-NH2 | 1485 | 1697.92 | 849.96 | 850.82 |
| 766 | Dmaac-LTF$r8AYWAQL$S-NH2 | 1486 | 1574.89 | 788.45 | 788.82 |
| 767 | Hexac-LTF$r8AYWAQL$S-NH2 | 1487 | 1587.91 | 794.96 | 795.11 |
| 768 | Napac-LTF$r8AYWAQL$S-NH2 | 1488 | 1657.89 | 829.95 | 830.36 |
| 769 | Pam-LTF$r8AYWAQL$S-NH2 | 1489 | 1728.06 | 865.03 | 865.45 |
| 770 | Ac-LT2Nal$r8HYAAQL$S-NH2 | 1490 | 1532.84 | 767.42 | 767.61 |
| 771 | Ac-LT2Nal$/r8HYWAQL$/S-NH2 | 1491 | 1675.91 | 838.96 | 839.1 |
| 772 | Ac-LT2Nal$r8HYFAQL$S-NH2 | 1492 | 1608.87 | 805.44 | 805.9 |
| 773 | Ac-LT2Nal$r8HWAAQL$S-NH2 | 1493 | 1555.86 | 778.93 | 779.08 |
| 774 | Ac-LT2Nal$r8HYAWQL$S-NH2 | 1494 | 1647.88 | 824.94 | 825.04 |
| 775 | Ac-LT2Nal$r8HYAAQW$S-NH2 | 1495 | 1605.83 | 803.92 | 804.05 |
| 776 | Ac-LTW$r8HYWAQL$S-NH2 | 1496 | 1636.88 | 819.44 | 819.95 |
| 777 | Ac-LT1Nal$r8HYWAQL$S-NH2 | 1497 | 1647.88 | 824.94 | 825.41 |

In some embodiments, a peptidomimetic macrocycles disclosed herein do not comprise a peptidomimetic macrocycle structure as shown in Table 4b.

Table 4c shows examples of non-crosslinked polypeptides comprising D-amino acids.

TABLE 4c

| SP | Sequence | SEQ ID NO: | Isomer | Exact Mass | Found Mass | Calc (M + 1)/1 | Calc (M + 2)/2 | Calc (M + 3)/3 |
|---|---|---|---|---|---|---|---|---|
| SP765 | Ac-tawyanfekllr-NH2 | 1498 | | | 777.46 | | | |
| SP766 | Ac-tawyanf4CF3ekllr-NH2 | 1499 | | | 811.41 | | | |

Example 2: Safety and/or Tolerability Study

Study Objectives

This study is designed to (i) evaluate the safety and/or tolerability of peptide 1, which is peptide of this disclosure, administered by IV infusion once weekly for three consecutive weeks of a 21 or a 28-day cycle, and (ii) determine the DLTs and the MTD or OBD of peptide 1 in patients with advanced liquid cancers expressing WT p53 protein. Peptide 1 is an alpha helical hydrocarbon cross-linked polypeptide macrocycle, with an amino acid sequence less than 20 amino acids long that is derived from the transactivation domain of wild type human P53 protein and that contains a phenylalanine, a tryptophan and a leucine amino acid in the same positions relative to each other as in the transactivation domain of wild type human P53 protein.

Peptide 1 has a single cross link spanning amino acids in the i to the i+7 position of the amino acid sequence and has more than three amino acids between the i+7 position and the carboxyl terminus. Peptide 1 binds to human MDM2 and MDM4 and has an observed mass of 950-975 m/e as measured by electrospray ionization-mass spectrometry.

Investigational Plan

Study Design

This study comprises a dose-escalation, 2-arm study designed to evaluate the safety, tolerability, PK, PD, and anti-liquid cancer cell effects of peptide 1 administered by IV infusion using 2 different dosing regimens of a 28- or 21-day cycle, in patients with advanced liquid cancer (e.g. leukemia, myeloma, and liquid lymphoma) expressing WT p53 protein (see p53 Status Determination below). For example, peptide 1 can be used in patients with relapsed/refractory acute myeloid leukemia (AML) and/or acute lymphoid leukemia (ALL). Patients receive peptide 1 either once weekly for three consecutive weeks for a 28-day cycle or twice weekly for two consecutive weeks for a 21-day cycle. Many patients with a liquid lymphoma present circulating tumor cells (CTC) in peripheral blood, which can be detected and analyzed using flow cytometry. Thus, detection of study drug-specific target engagement in these cells is possible.

The study consists of a Dose Escalation Phase (DEP) and an Expansion Phase (EXP). The DEP is a "3+3" dose escalation design to establish the MTD or OBD of peptide-1. The EXP enrolls up to 2 distinct groups of patients with specific liquid cancers at the MTD or OBD to further investigate the clinical safety profile and potential efficacy of the dose level. The selection of patients for the EXP is finalized based on results of the DEP, as well as data from additional nonclinical pharmacology studies. The later includes the investigation of multiple liquid cancer cell lines (e.g., leukemia, liquid lymphoma, myeloma) that facilitate the comparison of cell line sensitivity to peptide-1 across and within liquid cancer types.

Treatment of patients in the dose escalation and the dose expansion phases of the study continues until documentation of disease progression, unacceptable toxicity, or patient or physician decision to discontinue therapy.

p53 Status Determination and Tumor Sampling Requirement prior to Enrollment:

A central laboratory tests both archived tissue samples or fresh biopsy samples from all patients enrolled in the study for p53 status using Next-Generation Sequencing (NGS).

For the First 3 Dose Levels of Stage 1:

Patients can be enrolled irrespective of p53 status. Nevertheless, patients are still tested for p53 status at the central laboratory. To this end, archived tissue can be used (e.g., sample must not be older than 3 years), or alternatively, a fresh biopsy can be considered, unless the biopsy poses a significant risk to the patient.

Starting at Dose Level 4 of Stage 1 (and for Patients Enrolled in Stage 2 of the DEP):

Only patients with liquid cancer cells expressing WT p53 protein are enrolled. This key inclusion criterion is based on the proposed mechanism of action of peptide 1, which requires WT p53 protein to be pharmacologically active. The inclusion criterion is also supported by results of in vitro liquid cancer cell growth assays, in which peptide 1 demonstrates activity in liquid cancer cells expressing WT p53 protein, but not in cells with mutations of p53. Patients can meet the p53 requirement through one of the following scenarios:

Patients can be eligible based on a previous p53 gene test result done at a local lab. These patients are still tested for p53 status using NGS at the central laboratory. To this end, archived tissue can be used (sample must not be older than 3 years), or alternatively, a fresh biopsy should be considered, unless the biopsy poses a significant risk to the patient. Patients who do not have archived tissue and for whom a biopsy poses a significant risk are not enrolled.

Patients can be eligible based on archived tissue tested for p53 (sample must not be older than 3 years) at the central lab, or alternatively, a fresh biopsy can be considered, unless the biopsy poses a significant risk to the patient. Patients who do not have archived tissue and for whom a biopsy poses a significant risk, are not enrolled.

For patients enrolling into the EXP:

Only patients with liquid cancer cells expressing p53 WT are enrolled, and all patients must be tested for p53 status using NGS at the central laboratory PRIOR to enrollment. Archived tissue can be used (sample must not be older than 1 year), or alternatively, a fresh biopsy can be considered, unless the biopsy poses a significant risk to the patient. Patients who do not have archived tissue and for whom a biopsy poses a significant risk, are not enrolled.

Only patients with liquid cancer cells expressing WT p53 protein are enrolled. The determination of p53 status is performed on liquid cancer cell samples obtained during the screening period. The assay can be performed by study sites with required capabilities; otherwise it can be performed at a central laboratory. Results from archival tissue samples, if available, can be used to determine patient eligibility in the DEP. The total number of patients enrolled in the study depends on the number of dose levels and the number of patients in each cohort before MTD or OBD is established. Approximately 45 patients, exclusive of replacements for patients who discontinue for non-safety reasons, are enrolled in the DEP, and a total of up to approximately 60 additional patients for each of the up to two patient groups (total of 60) are enrolled in the EXP cohorts. Enrollment of a total of up to 100 patients is planned for the study. Approximately 6 clinical sites in the US are planned. The expected accrual phase is approximately 15 months. The expected follow-up phase is approximately 8 months after the last patient is enrolled, for a total study duration of approximately 23 months.

Patients who satisfy all inclusion and exclusion criteria, including documentation of WT p53 status, are enrolled in cohorts of 3 to 6 patients to receive peptide 1. Peptide 1 is administered by IV infusion in Dose Regimen A over 1 hour (±5 min) on Days 1, 8 and 15 of a 28-day cycle or in Dose Regimen B also over 1 hour (±5 min), starting at Dose Level 3, on Days 1, 4, 8, 11 of a 21-day cycle.

Treatment continues until disease progression, unacceptable toxicity or patient or physician withdrawal of consent. After the MTD or OBD is established, additional patients can be enrolled in up to two separate expansion cohorts (approximately 30 patients per expansion cohort to gain further experience at this dose level and in particular patient or liquid cancer cell types. Selection of patient or liquid cancer cell types is determined in part on the basis of observations made in the dose escalation portion of the study.

Safety is evaluated based on the incidence, severity, duration, causality, seriousness, and type of AE, and changes in the patient's physical examination, vital signs and clinical laboratory results. Investigators use the NCI CTCAE version 4.0 to assess the severity of AEs.

Because the primary objectives of this study are based on safety and PK, statistical analyses are descriptive in nature and accounts for all doses studied and all observed responses, including patients who achieve a complete response (CR) or partial response (PR) or who maintain stable disease (SD) based on IWG (2014) criteria. Patients who receive at least one dose of peptide 1 constitute the safety population and are included in all safety analyses. Patients who complete at least one cycle of peptide 1 and undergo a post-treatment objective disease assessment constitute the efficacy-evaluable patient population.

Patient Population

Inclusion Criteria

All AML patients are required to have relapsed or refractory acute myeloid leukemia according to WHO criteria. Patients with acute promyelocytic leukemia are excluded. All MDS patients are required to have: (i) Diagnosis of MDS confirmed within 8 weeks prior to study entry; (ii) Not responsive to or intolerant to hypomethylating agents (azacytidine or decitabine); (iii) IPSS-R intermediate/high/very high-risk MDS patients (applying IPSS-R criteria at screening); or, if IPSS-R status cannot be determined (e.g., if cytogenetics are not available due to dry tap), FAB classification: RAEB-1 (5% to 9% BM blasts), RAEB-2 (10% to 19% BM blasts), CMML (10% to 20% BM blasts) and WBC<13,000/μL, RAEB-t (20% to 30% BM blasts); (iv) MDS patients must also meet at least one of the following: a. Progression (according to 2006 IWG criteria) at any time after initiation of azacitidine or decitabine treatment; b. Failure to achieve complete or partial response or hematological improvement (according to 2006 IWG) after at least six 4-week cycles of azacitidine or decitabine; c. Relapse after initial complete or partial response or hematological improvement (according to 2006 IWG criteria) observed after at least four 4-week cycles of azacitidine or decitabine; d. Intolerance to azacitidine or decitabine defined by drug-related ≥Grade 3 liver or renal toxicity leading to treatment discontinuation.

All patients are required to meet the following inclusion criterias: (i) Male or female patients age 18 years and older, inclusive, at the time of informed consent (ii) Histologically- or cytologically-confirmed liquid cancers. Standard curative measures do not exist or are no longer effective; (iii) WT p53 status for the relapsing or treatment-refractory liquid neoplasm is mandatory for patients enrolling at Dose Level 4 and higher in Stage 1 of the DEP, as well as for all patients enrolled in Stage 2 of the DEP or in the EXP; (iv) at least one target lesion that is measurable by Revised International Working Group Response Criteria (IWG (2014)) in liquid lymphoma patients (v) ECOG performance status 0-1; (vi) predicted life expectancy of ≥3 months; (vii) adequate hematologic function, measured within 7 days prior to the first dose of peptide 1 (defined as: ANC ≥1.5×10$^9$/L, Hemoglobin ≥9.0 g/d, and Platelets ≥100×10$^9$/L); (viii) adequate hepatic function, measured within 7 days prior to the first dose of peptide 1 (defined as: in the absence of disease involvement in the liver:bilirubin≤51.5 times institutional ULN: AST and ALT ≤2.5 times ULN; in the presence of disease involvement in the liver:bilirubin ≤2 times ULN: AST and ALT ≤5 times ULN, (ix) adequate renal function, measured within 7 days prior to the first dose of peptide 1, (defined as: urinalysis with no evidence of +2 or higher proteinuria, serum creatinine ≤1.5 times institutional ULN or calculated creatinine clearance ≥50 mL/min (Cockcroft-Gault formula)); (x) acceptable coagulation profile, measured within 7 days prior to the first dose of peptide 1 (defined as: PT or INR≤1.5 times ULN; aPTT≤1.5 times ULN); (Xi) at least 4 weeks since prior chemotherapy or biologic therapy, radiotherapy or surgery (intra-thoracic, intra-abdominal or intra-pelvic) with recovery to Grade 1 or baseline of significant toxicities, excluding alopecia, from previous therapies. Palliative radiotherapy for bone lesions ≤2 weeks prior to the first dose of peptide 1 is acceptable if acute toxicity has resolved; (xii) negative serum pregnancy test within 14 days prior to the first dose of peptide 1 for women of child-bearing potential, defined as a sexually mature woman who has not undergone a hysterectomy or who has not been naturally postmenopausal for ≥24 consecutive months (i.e., who has had menses any time in the preceding 24 consecutive months); (xiii) all patients (males and females) of child-bearing potential agree to use an effective method of birth control (i.e., latex condom, diaphragm, cervical cap, IUD, birth control pill, etc.) beginning two weeks before the first dose of peptide 1 and for 30 days after the last dose of peptide 1; (xiv) ability to understand and willingness to sign a written informed consent document; and patients with prostate cancer must continue androgen deprivation therapy, unless such therapy was discontinued 6 months prior to first dose of peptide 1. In a study of using peptide 1 for acute myeloid leukemia (AML) or acute lymphoid leukemia (ALL), patients with pathological confirmation of AML or ALL, such as B-cell acute lymphoid leukemia (B-ALL) and T-cell acute lymphocytic leukemia (T-ALL), are included. In such study, patients who are relapsed, refractory or intolerant to standard chemotherapy are included.

Exclusion Criterias

Patients who meet any of the following criteria at screening or Day-1 are excluded: (i) previous treatment with investigational agents that affect MDM2 or MDMX activity; known hypersensitivity to any study drug component; (iii) known and untreated brain metastases. Patients with brain metastases that have been treated and demonstrated to be clinically stable for ≥30 days can be enrolled onto the dose escalation portion of the study; (iv) history of coagulopathy, platelet disorder or history of non-drug induced thrombocytopenia; (v) history of pulmonary embolism within 6 months prior to the first dose of peptide 1 or untreated DVT; (vi) required concurrent use of anti-coagulants or anti-platelet medication, with the exception of aspirin doses ≤81 mg/day, low-dose SC heparin or SC low-molecular-weight heparin for DVT prophylaxis, or heparin flushes to maintain IV catheter patency; (vii) patients with pre-existing history of or known cardiovascular risk (for example: history of acute coronary syndromes including myocardial infarction, unstable angina, coronary artery bypass graft, angioplasty, or stenting within 6 months prior to the first dose of peptide 1; uncontrolled hypertension defined as a systolic BP ≥160 mmHg and/or diastolic BP ≥100 mmHg; pre-existing cardiac failure (New York Heart Association class III-IV); atrial fibrillation on anti-coagulants; clinically significant uncontrolled arrhythmias or arrhythmia requiring treatment, with the exceptions of atrial fibrillation and paroxysmal supraventricular tachycardia; severe valvulopathy; corrected QTc interval on screening ECG≥450 msec for males and ≥470 msec for females); (viii) clinically significant gastrointestinal bleeding within 6 months prior to the first dose of peptide 1; (ix) clinically significant third-space fluid accumulation (e.g., ascites requiring tapping despite the use of diuretics, or pleural effusion that requires tapping or is associated with shortness of breath); (x) pregnant or lactating females; (xi) evidence of serious and/or unstable preexisting medical, psychiatric or other condition (including laboratory abnormalities) that could interfere with patient safety or provision of informed consent to participate in this study; (xii) active uncontrolled infection, a history of HIV/AIDS, or a history of hepatitis B or C in the absence of hepatocellular carcinoma. Patients with primary liver cancer that have positive hepatitis serology but are not demonstrating active viral hepatitis can be considered for enrollment if they meet all other inclusion and no other exclusion criteria; (xiii) starting at dose level 4 and higher in Stage 1 of the DEP (as well as for all patients enrolling in Stage 2 of the DEP or in the EXP): Cancers with known Human Papilloma Virus (HPV)-association such as HPV-positive cervical cancers, HPV-positive oropharyngeal cancers or HPV-positive anal cancers; (xiv) known history of another primary malignancy that has not been in remission for ≥2 years. Non-melanoma skin cancer and cervical carcinoma in situ or squamous intraepithelial lesions (e.g., CIN or PIN) are allowed; (xv) any psychological, sociological, or geographical condition that could potentially interfere with compliance with the study protocol and follow-up schedule; (xvi) the required use of any concomitant medications that are predominantly cleared by hepatobiliary transporters (e.g., OATP members OATPIBI and OATP1B3) within 24 hours of peptide 1 infusion; (xvii) the use of any investigational agents within 4 weeks or 5 circulating half-lives prior to the first dose of peptide 1. In a study of using peptide 1 for acute myeloid leukemia (AML) or acute lymphoid leukemia (ALL), patients with acute undifferentiated or biphenotypic leukemia are excluded. Patients with a leukemic blast count of more than 50,000/uL are excluded. Patients with deletion of chromosome 17, or del(17p) are excluded.

Patient Removal/Replacement from Study Therapy

A patient can be removed from the study therapy for a variety of reasons, including: (i) disease progression; (ii) unacceptable adverse event(s); (iii) intercurrent illness that prevents further participation; (iv) clinically significant toxicity despite a 2-week dosing delay or after two dose reductions; (v) patient refusal to continue treatment through the study and/or consent withdrawal for study participation; (vi) patient unable or unwilling to comply with study requirements; (vii) pregnancy or failure to use adequate birth control; (viii) general or specific changes in the patient's condition that render the patient unacceptable for further treatment in this study in the judgment of the investigator Any patient who completes screening and does not receive a dose of peptide 1 is replaced. A patient in the dose escalation portion of the study who discontinues the study prior to completion of the first cycle for reasons other than safety is replaced. A patient in the dose expansion portion of the study who discontinues study participation prior to the completion of the first cycle of treatment for any reason can be replaced.

Treatment Plan

Study Drug Administration

The study drug is the investigational agent peptide 1. This investigational agent is distributed to clinical sites. Patients begin treatment with peptide 1 within 21 days following the start of screening. Peptide 1 drug is a frozen liquid product supplied in single-use glass vials. The peptidomimetic macrocycle for injection is stored frozen at ≤−15° C. Peptide 1 is introduced into an IV infusion bag containing D5W; this is known as peptide 1 dosing solution and is provided by the site pharmacy for administration to the patient. Peptide 1 dosing solution is labeled with a patient identification number. An investigative staff confirms this information and its relevancy to the intended patient. Peptide 1 is administered by IV infusion in D5W over 1 hour (±5 min) on Days 1, 8 and 15 of a 28-day cycle for DR-A or Days 1, 4, 8, 11 for DR-B of a 21 day treatment cycle. The pre-defined dose is calculated for each patient based on body weight at the start of each cycle.

Peptide 1 is not administered outside of the planned schedule for Dose Regimens A and B in Cycle 1, i.e., there are no planned windows for dose days. Follow-up visits on non-dosing days have a window of ±1 day in DR-A on Days 22 and 29 and in DR-B on Days 18 and 21. Deviations are noted on the eCRF. Treatment of patients in the dose escalation and the dose expansion phases of the study continue until documentation of disease progression, unacceptable toxicity, or patient or physician decision to discontinue therapy.

In case of infusion-related reactions, peptide 1 infusion is temporarily discontinued. Pharmacologic agents and other therapeutic interventions can be administered per institutional guidelines. The decision to re-start peptide 1 infusion is made after a careful assessment of the patient.

Starting Dose, Dose Escalation and Dose Reduction

Starting at Dose Level (DL) 3, patients are sequentially assigned to one of two treatment arms: Dose Regimen (DR) A continues testing administration of peptide 1 once per week, or Dose Regimen (DR) B testing administration of peptide 1 twice per week. For Dose Level 3, DR-A is enrolled first, DR-B is enrolled second. The starting dose (DL-1) in DEP, based on results from nonclinical toxicology assessments, is 0.16 mg/kg. During the first 2 dose levels, patients receive peptide 1 on Days 1, 8, and 15 of a 28-day cycle. Starting with DL 3, patients in DR-A continues being treated once a week on Days 1, 8, and 15 of a 28-day cycle, whereas patients in DR-B are treated twice a week, on Days 1 and 4, 8 and 11 of a 21-day cycle.

Dose Levels for the Dose Escalation Portion of Study

In the Dose Escalation portion of the study, increasing dose levels of peptide 1 are evaluated in cohorts of 3-6 patients. Peptide 1 is administered by IV infusion using 2 different dosing regimens of a 28- or 21-day cycle, in patients with advanced liquid lymphomas expressing WT p53 protein. Patients receive peptide 1 either once weekly for three consecutive weeks for a 28-day cycle or twice weekly for two consecutive weeks for a 21-day cycle. Many patients with a liquid lymphoma present circulating tumor cells (CTC) in peripheral blood, which can be detected and analyzed using flow cytometry. This analysis allows detection of study drug-specific target engagement in these cells. Based on allometric scaling, the projected AUC in humans at 0.16 mg/kg (50 μg·hr/mL) is approximately 9% of the rat AUC at $STD_{10}$ and approximately 6% of the AUC at the monkey HNSTD.

In the absence of DLT in ≥33% of patients in either DR, subsequent cohorts of 3 to 6 patients will receive escalated doses until the MTD or an OBD is established for each dose regimen.

A 2-stage dose escalation design is employed. During the initial Stage 1 Escalation Phase (Table 5), 100% dose increments are utilized until ≥1 of 3 patients in a cohort experiences any Grade ≥2 AE that is at least possibly related to study drug. Subsequent dose escalation will continue using 3-patient cohorts and the modified Fibonacci sequence (i.e., Stage 2 Escalation Phase; Table 6), until the MTD or OBD is established.

TABLE 5

Dose Level and Dose Regimen Schematic

| Dose Escalation Phase (DES) | | | | | | | Dose Expansion Phase Dose(s) & Regimen(s) to be Determined P53 WT Pre-Dose 1 Fresh Sample |
|---|---|---|---|---|---|---|---|
| Dose Level 1 | Dose Level 2 | Dose Level 3A | Dose Level 4A | Dose Level 5A | Dose Level 6A | Dose Level 7A | |
| Per Dose, mg/Kg | | | | | | | |
| 0.16 mg/Kg | 0.32 mg/Kg | 0.64 mg/Kg | 1.25 mg/Kg | 2.5 mg/Kg | 5.0 mg/Kg | 10.0 mg/Kg | |
| Only Dose Regimen A | | DR-A: 1×/wk for 3 wks, 28 day Cycle | | | | | |
| | | Liquid Cancer | | | | | |
| | | DR-B: 2×/wk for 2 wks, 21 Day Cycle | | | | | |
| | | 0.32 mg/Kg | 0.64 mg/Kg | 1.25 mg/Kg | 2.5 mg/Kg | 5.0 mg/Kg | |
| | | Per Dose, mg/Kg | | | | | |
| | | Dose Level 3B | Dose Level 4B | Dose Level 5B | Dose Level 6B | Dose Level 7B | |
| | | ←—p53 WT Not Necessary—→ Archive Sample Used if Available | | ←———p53 WT Pre-Dose 1 Necessary———→ From Archive or Fresh Sample | | | |

TABLE 5-continued

Dose Level and Dose Regimen Schematic

Dosing Overview

| Clinical Screen Day -21 to Day -1 | Dose Regimen A Clinic Visits - 28 Day Cycle | | | | | | | Begin Next Cycle |
|---|---|---|---|---|---|---|---|---|
| | Dose: Day 1 | Day 2 | Day 3 | Dose: Day 8 | | Dose: Day 15 | Day 16 | Day 22 | Day 29 |
| | Dose Regimen B Clinic Visits - 21 Day Cycle | | | | | | | Begin Next Cycle |
| | Dose: Day 1 | Day 2 | Day 3 | Dose: Day 4 | Dose: Day 8 | Dose: Day 11 | Day 12 | Day 18 | Day 22 |

Peptide 1 Administration for each Dose Level (DL) and Dose Regimen

| Dose Regimen A | Dose- Day 1 mg/Kg | Dose- Day 8 mg/Kg | Dose- Day 15 mg/Kg | | Total Dose per Cycle mg/Kg |
|---|---|---|---|---|---|
| Dose Level 3 | 0.64 | 0.64 | 0.64 | 28-Day Cycle | DL 3- 1.92 |
| DL 4 | 1.25 | 1.25 | 1.25 | | DL 4- 3.75 |
| DL 5 | 2.5 | 2.5 | 2.5 | | DL 5- 7.5 |
| DL 6 | 5.0 | 5.0 | 5.0 | | DL 6- 15.0 |
| DL 7 | 10.0 | 10.0 | 10.0 | | DL 7- 30.0 |

| Dose Regimen B | Dose- Day 1 mg/Kg | Dose- Day 4 mg/Kg | Dose- Day 8 mg/Kg | Dose- Day 11 mg/Kg | | Total Dose per Cycle mg/Kg |
|---|---|---|---|---|---|---|
| Dose Level 3 | 0.32 | 0.32 | 0.32 | 0.32 | 21-Day Cycle | DL 3- 1.28 |
| DL 4 | 0.64 | 0.64 | 0.64 | 0.64 | | DL 4- 2.56 |
| DL 5 | 1.25 | 1.25 | 1.25 | 1.25 | | DL 5- 5.0 |
| DL 6 | 2.5 | 2.5 | 2.5 | 2.5 | | DL 6- 10.0 |
| DL 7 | 5.0 | 5.0 | 5.0 | 5.0 | | DL 7- 20.0 |

The escalation scheme can be switched to the Stage 2 Escalation Schedule at any point that the Investigators, Sponsor's Medical Monitor and Safety Physician representative agree on a more conservative progression.

The observation of DLT(s) is used to make individual patient determinations regarding dose reductions, interruptions or discontinuation throughout the course of the trial, but DLTs occurring during Cycle 1 is used to inform safety and tolerability assessments for dose escalation decisions.

If DLTs are observed in the first cohort, the dose is de-escalated to Dose Level-1. If DLTs are observed at Dose Level-1, the dose is de-escalated to Dose Level-2. If DLTs are observed at Dose Level-2, other dose levels can be considered and implemented after discussions among the Investigators, Sponsor's Medical Monitor and Safety Physician representative.

Within each Dose Regimen:

If no DLT is observed in a cohort, the subsequent patient group is enrolled at the next planned dose level of that dose regimen.

If DLT is observed in ≥2 of 3 patients at any dose level no further dose escalation occurs in that DR, and the current dose is defined as the MAD.

If DLT is observed in 1 of 3 patients at any dose level, then up to 3 additional patients are enrolled in the same DR at that same dose level. If DLT is observed in ≥2 patients in the expanded cohort, then no further dose escalation occurs, and the current dose is defined as the MAD.

After the MAD is defined, either the previously administered lower dose is expanded to a total of 6 patients, or an intermediate (between the MAD and the next lower dose level) is investigated in up to six patients. The highest dose tolerated without DLT in at least 5 of 6 patients in a cohort from one treatment arm is defined as the MTD or OBD for that treatment arm.

The selection of dose regimen and dose level for up to 2 EXP cohorts is based on the MTD determination in Cycle 1, as well as the cumulative safety, efficacy and PK/PD profile of peptide 1 in subsequent treatment cycles in DEP.

Dose levels are be increased between cycles within each cohort, and patients are assigned only one dose level (i.e., no intra-patient dose escalation).

Dose Level for the Expansion Portion of Study

After the MTD or OBD is defined, approximately 30 additional patients can be enrolled in up to two expansion cohorts of the study to gain further experience at this dose level and investigate the effect of peptide 1 in specific patient or liquid cancer cell types. There can be up to two expansion cohorts, for which two disease types can be selected for evaluation. The dose and dosing schedule of peptide 1 administered to patients in the expansion cohort is derived from evaluation of available safety and other information from patients from both dose regimens in the dose escalation portion of the study.

Intra-Patient Dose Escalation

Intra-patient dose escalation is not be permitted.

Dose and Schedule Adjustments for Toxicity

Toxicity that occurs during a cycle must recover as outlined below for treatment to continue. Hemoglobin ≥8.5 g/dL; ANC ≥1.0 $10^9$/L; platelet count ≥75×$10^9$/L; liver function tests back to grade prior to previous cycle (includes PT/INR); other toxicities must return to Grade ≤1 or to baseline level if Grade >1 was acceptable for inclusion in the trial as described in the criteria listed in Section 4.

In the event a Grade 4 AE considered related to peptide 1 is observed, peptide 1 must be discontinued permanently. Exceptions include Grade 4 neutropenia lasting <3 days, and emesis, diarrhea or electrolyte abnormalities that resolve within 2 days on optimum treatment. For these exceptions, treatment can be delayed for up to 2 weeks to allow resolution of the toxicity (i.e., return to Grade ≤1 or baseline), followed by re-treatment at a reduced dose. Two dose reductions are permitted. A third dose reduction requires evidence of clinical benefit and approval by the Medical Monitor.

In the event a Grade 3 AE considered related to peptide 1 is observed (exceptions are Grade 3 nausea, emesis, diarrhea or clinically insignificant electrolyte abnormalities that resolve within 2 days on optimum treatment), treatment can be delayed for up to 2 weeks to allow resolution of the toxicity, followed by re-treatment at a reduced dose. Two dose reductions are permitted. A third dose reduction require evidence of clinical benefit and approval by the Medical Monitor.

Dose modifications for re-treatment following related Grade 3 and Grade 4 AEs (as permitted) is as follows. For DEP, patients are re-treated at the preceding dose level (per Table 1 and/or Table 2). For EXP, doses are reduced by 25% intervals (e.g., if the Phase II dose is 5 mg/kg, the dose is reduced sequentially to 3.75 mg/kg and 2.8 mg/kg). Two dose reductions are permitted. A third dose reduction requires evidence of clinical benefit and approval by the Medical Monitor.

If a clinically significant AE is observed in a patient during a treatment cycle, further dosing is delayed until the toxicity has resolved to an acceptable level. Treatment can be delayed by up to 2 weeks to allow for the resolution of AEs, and a dose reduction to the preceding level can be made at the discretion of the Investigator in consultation with Sponsor's Medical Monitor and Safety Physician representative. If a patient experiences multiple AEs, decisions on dosing delay or dose reduction can be based on the most severe AE. Any patient who experiences recurrent, clinically significant AE after one dose reduction can undergo one additional dose reduction. Patients who continue to experience clinically significant toxicity after a 2-week delay or the maximum allowed number of dose reductions are discontinued from the study.

Adverse events considered for dose reduction do not include the events assessed by the investigator as exclusively related to underlying disease or other medical condition or concomitant treatment. A patient who experiences an AE considered related to peptide 1 can continue on study if the patient is receiving clinical benefit and/or the Investigator feels continued participation is in the best interest of the patient. In such cases, at the Investigator's discretion and in agreement with Sponsor's Medical Monitor and Safety Physician representative, the dose for a patient can be reduced to the preceding lower level.

Up to two dose reductions for a patient are permitted. A third dose reduction requires evidence of clinical benefit and approval by the Medical Monitor, after which the patient is discontinued from the study.

A patient who experiences a DLT can continue treatment at the preceding lower level at the discretion of the Investigator and in agreement with Sponsor's Medical Monitor and Safety Physician representative until disease progression or unacceptable toxicity. Once the dose has been reduced for a patient, it can not be re-escalated.

Toxicity grading is based on NCI CTCAE v4.0.

Statistical Methods

Statistical analyses of safety and efficacy for DEP and EXP are primarily descriptive in nature because the objectives of the study are to determine the DLTs and MTD or OBD. These objectives are achieved by the results of a deterministic algorithm: Continuous variables are summarized using descriptive statistics [n, mean, standard deviation, median, minimum, and maximum]. Categorical variables are summarized showing the number and percentage (n, %) of patients within each classification. Results are evaluated for all patients and liquid lymphoma patients. Results from DR-A and DR-B are compared for all Dose Levels and patient groups.

Example 3: Study Procedures

Schedule of Study Events

The schedule of study activities, including assessments, tests, exams, disease assessments, submission of tissue specimens, and study drug administration) that is conducted, beginning with screening and continuing through Cycle 1 [day 1, day 8, and day 15 of a 28 day cycle] is outlined in Table 7. The study that is conducted beginning with Cycle 2 [day 29 of cycle 1=day 1 of cycle 2] is outlined in Table 8.

TABLE 7

Schedule of study activities through Cycle 1

| | Molecular Screen | Clinical Screen -21 days for DR-B, All Dose Levels | Day -7 for DR-A and DR-B, All Dose Levels | Day 1 for DR-A and DR-B, All Dose Levels pre-dose | Day 1 post-dose | Day 2 ±4 h for DR-A and DR-B, All Dose Levels | Day 3 ±4 h for DR-A and DR-B, All Dose Levels | Day 4 (DR-B only) pre-dose | Day 4 post-dose | Day 8 for DR-A and DR-B, All Dose Levels pre-dose | Day 8 post-dose | Day 11 (DR-A only) Day 15 (DR-B only) pre-dose | Day 11/Day 15 post-dose | Day 12 (DR-B only) Day 16 (DR-A only) ±2 d | Day 18 (DR-B only) Day 22 (DR-A only) ±1 d | Day 22 (DR-B only) Day 1, Cycle 2 Day 29/Day 1, Cycle 2 ±3 d (DR-A only) |
|---|---|---|---|---|---|---|---|---|---|---|---|---|---|---|---|---|
| Written informed consent | X | | | | | | | | | | | | | | | |
| Medical history | | X | | | | | | | | | | | | | | |
| Demographics | | X | | | | | | | | | | | | | | |
| Tumor biopsy or archive tissue sample for p53 WT confirmation and biomarker assessment | X | | | | | | | | | | | | | | | |
| Confirm eligibility | | X | X | | | | | | | | | | | | | |
| Blood test for HIV, hepatitis B and C | | X | | | | | | | | | | | | | | |
| Serum or urine pregnancy | | X | | | | | | | | | | | | | | |
| Vital signs: Blood pressure, pulse, respiration rate, body temperature | | X | | X | X | X | X | | | X | X | X | X | | X | Refer to Table 7 |
| Physical exam | | X | | | | | | | | | | | | | | |
| 12-lead ECG | | X | | X | X | | | X | X | X | | | | | | |
| Laboratory assessments: Clinical chemistry (glucose, calcium, albumin, total protein, sodium, potassium, $CO_2$, chloride, BUN [blood urea nitrogen], | | X | X | X | | X | X | X | X | X | | | | X | X | |

TABLE 7-continued

Schedule of study activities through Cycle 1

| | Clinical Screen −21 days for DR-A and DR-B, All Dose Levels | Day −7 for DR-A and DR-B, All Dose Levels | Day 1 for DR-A and DR-B, All Dose Levels pre-dose / post-dose | Day 2 ±4 h for DR-A and DR-B, All Dose Levels | Day 3 ±4 h for DR-A and DR-B, All Dose Levels | Day 4 (DR-B only) pre-dose / post-dose | Day 8 for DR-A and DR-B, All Dose Levels pre-dose / post-dose | Day 11 (DR-A only) Day 15 (DR-B only) pre-dose / post-dose | Day 12 (DR-B only) Day 16 (DR-A only) ±2 d | Day 18 (DR-B only) Day 22 (DR-A only) ±1 d | Day 22 (DR-B only) Day 1, Cycle 2 Day 29/Day 1, Cycle 2 ±3 d (DR-A only) |
|---|---|---|---|---|---|---|---|---|---|---|---|
| Molecular Screen | DR-B, All Dose Levels | | | | | | | | | | Refer to Table 7 |
| serum creatinine, uric acid, ALP, ALT, AST, phosphate, total and direct bilirubin), hematology (complete blood count, platelets and differential), urinalysis (dipstick measurement [pH, specific gravity, protein, glucose, ketones, nitrite, leukocyte esterase] with microscopic analysis, if results of the dipstick indicate additional testing required), coagulation (PT, INR, aPTT). | | | X | | | X | | | | | |
| Collection of blood for immunogenicity | | | X / X | X | X | X / X | X / X | X / X | | | |
| Collection of blood for biomarker assessments | | | | | | | | X | X | X | |
| Collection of blood for PK assessments | | | X / X | X | X | X / X | X / X | X / X | X | | |

TABLE 7-continued

Schedule of study activities through Cycle 1

| | Clinical Screen −21 days for DR-A and DR-B, All Dose Levels | Day −7 for DR-A and DR-B, All Dose Levels | Day 1 for DR-A and DR-B, All Dose Levels pre-dose | Day 1 for DR-A and DR-B, All Dose Levels post-dose | Day 2 ±4 h for DR-A and DR-B, All Dose Levels | Day 3 ±4 h for DR-A and DR-B, All Dose Levels | Day 4 (DR-B only) pre-dose | Day 4 (DR-B only) post-dose | Day 8 for DR-A and DR-B, All Dose Levels pre-dose | Day 8 for DR-A and DR-B, All Dose Levels post-dose | Day 11 (DR-A only) Day 15 (DR-B only) pre-dose | Day 11 (DR-A only) Day 15 (DR-B only) post-dose | Day 12 (DR-B only) Day 16 (DR-A only) ±2 d | Day 18 (DR-B only) Day 22 (DR-A only) ±1 d | Day 22 (DR-B only) Day 1, Cycle 2 Day 29/Day 1, Cycle 2 ±3 d (DR-A only) |
|---|---|---|---|---|---|---|---|---|---|---|---|---|---|---|---|
| Molecular Screen | | | | | | | | | | | | | | | Refer to Table 7 |
| Collection of blood for PK assessments | | | | | | | | | | | | | X | | |
| FLT-PET for patients who received FLT-PET at screen and have SUV ≥5 | | | | | | | | | | | | | X | | |
| ECOG Performance Status | X | X | | | | | | | X | | | | | | |
| Needle biopsy for biomarker assessments | X | | | | | | | | | | | | X | | |
| Tumor Assessment | X | | | | | | | | | | | | | | |
| peptide 1 dosing | | | X | X | | | | | X | | | | | | |
| Concomitant medications | X | X | X | X | X | X | X | X | X | X | X | X | X | X | |
| AE assessment | | | | X | X | X | X | X | X | X | X | X | X | X | |
| TLS monitoring (via routine laboratory assessment sample) | | | | | X | X | X | X | X | X | X | X | X | X | |

TABLE 8

Dose Regimen A - Study Activities Through Cycle 1

| (DR-A) | Molecular Screen | Clinical Screen −21 days | Within 7 days prior to Day 1 | Day 1 Pre-Dose | Day 1 Post-Dose | Day 2 ±4 h | Day 3 ±4 h | Day 8 ±1 d Pre-Dose | Day 8 ±1 d Post-Dose | Day 15 ±1 d Pre-Dose | Day 15 ±1 d Post-Dose | Day 16 ±2 d | Day 22 ±1 d | Day 29/ Day 1, Cycle 2[1] ±3 d |
|---|---|---|---|---|---|---|---|---|---|---|---|---|---|---|
| Written informed consent | X | X | | | | | | | | | | | | |
| Medical history[2] | | X | | | | | | | | | | | | |
| Demographics | | X | | | | | | | | | | | X | |
| Pre-dose CT & FDG-PET/ FLT possibly | | | | | | | | | | | | | | |
| Tumor biopsy or archive tissue sample for p53 WT confirmation DL 4 and beyond and biomarker assessment | X | | | | | | | | | | | | | |
| Confirm eligibility | | X | X | | | | | | | | | | | |
| Blood test for HIV, hepatitis B and C | | X | | | | | | | | | | | | |
| Serum or urine pregnancy | | | X | | | | | | | | | | | |
| Vital signs | | X | X | X | X | X | X | X | X | X | X | X | X | |
| Physical exam | | X | | X | | | | X | | X | | | | |
| 12-lead ECG | | X | | X | X | | | | | | | | | |
| Laboratory assessments | | X | X | | | X | X | X | | X | | X | X | |
| Blood Collection - immunogenicity | | | | X | | | | | | | | | | |
| Blood Collection - biomarker assessments | | | | X | X | X | X | X | X | X | X | X | X | |
| Blood Collection - PK assessments | | | | X | X | X | X | X | X | X | X | X | | |
| ECOG Performance Status | | X | X | | | | | X | | X | | | | |
| Needle biopsy for biomarker assessments | | | | | | | | | | | | | X | |
| Tumor Assessment | | X | | | | | | | | | | | | |
| peptide 1 dosing | | | | X | | | | X | | X | | | | |
| Concomitant medications | | X | X | X | X | X | X | X | X | X | X | X | X | |
| AE assessment | | | | X | X | X | X | X | X | X | X | X | | |

TABLE 9

| (DR-B) | Molecular Screen | Clinical Screen −21 days | Within 7 days prior to Day 1 | Day 1 Pre-Dose | Day 1 Post-Dose | Day 2 ±4 h | Day 3 ±4 h | Days 4 and 8 Pre-Dose | Days 4 and 8 Post-Dose | Day 11 Pre-Dose | Day 11 Post-Dose | Day 12 | Day 18 ±1 d | Day 21/Day 1, Cycle 2$^1$ ±2 d |
|---|---|---|---|---|---|---|---|---|---|---|---|---|---|---|
| Dose Regimen B - Study Activities Through Cycle 1 ||||||||||||||| 
| Written informed consent | X* | X** | | | | | | | | | | | | |
| Medical history | | X | | | | | | | | | | | | |
| Demographics | | X | | | | | | | | | | | X | |
| Pre-dose CT & FDG-PET/FLT possibly | | | | | | | | | | | | | | |
| Tumor biopsy or archive tissue sample for p53 WT confirmation DL 4 and beyond, and biomarker assessment | X | | | | | | | | | | | | | |
| Confirm eligibility | | X | X | | | | | | | | | | | |
| Blood test for HIV, hepatitis B and C | | X | | | | | | | | | | | | |
| Serum or urine pregnancy | | | X | | | | | | | | | | | |
| Vital signs | | X | X | X | X | X | X | X | X | X | X | X | X | |
| Physical exam | | X | | X | | | | X | | X | | | | |
| 12-lead ECG | | X | | X | X | | | | | | | | | |
| Laboratory assessments | | X | X | | | X | X | X | | X | | | X | X |
| Blood Collection - immunogenicity | | | | X | | | | X | | | | | | |
| Blood Collection - biomarker assessments | | | | X | X | X | X | X | X | X | X | X | X | |
| Blood Collection - PK assessments | | | | X | X | X | X | X | X | X | X | X | | |
| ECOG Performance Status | | X | X | | | | | X | | X | | | | |
| Needle biopsy for biomarker assessments | | | | | | | | | | | | | X | |
| Tumor Assessment | | X | | | | | | | | | | | | |
| peptide 1 dosing | | | | X | | | | X | | X | | | | |
| Concomitant medications | | X | X | X | X | X | X | X | X | X | X | X | X | X |
| AE assessment | | | | | X | X | X | X | X | X | X | X | X | |

TABLE 10

| | Schedule of study activities through Cycle 2 | | | | | | | | |
|---|---|---|---|---|---|---|---|---|---|
| | Day 29 for DR-A and Day 22 DR-B of cycle/Day 1 of next cycle for patients continuing treatment ±3 d | | Day 8 of DR-A and Days 4 and 8 of DR-B ±1 d | | Day 15 of DR-A and Day 11 of DR-B ±1 d | | Day 16 DR-A | After even | CT Imaging* | End-of-Study 30 ±3 d after last dose |
| | Pre-dose | post-dose | pre-dose | Post-dose | pre-dose | post-dose | and Day 12 of DR-B ±2 d | numbered cycles | Prior to first dose | or study withdrawal |
| Serum pregnancy | | | | | | | | | | X |
| Vital signs: Blood pressure, pulse, respiration rate, body temperature. | X | X | X | X | X | X | X | | | X |
| Physical exam | X | | X | | X | | | | | X |
| 12-lead ECG | X pre-dose and EOI (+10 min) | X At pre-dose and EOI (+10 min) | | | | | | | | X |
| Laboratory assessments: Clinical chemistry, hematology, urinalysis, coagulation (PT, INR, aPTT). | X | | X (Hematology only) | | X | | X | | | X |
| Collection of blood for immunogenicity | X | | | | | | | | X | X |
| Collection of blood for biomarker assessments (each cycle) | X (MIC-1 only) | X (MIC-1 only) | | | X (MIC-1 only) | X (MIC-1 only) | X | | | X |
| Collection of blood for PK assessments (Cycle 2 and End-of-Study only) | X | X | | | X | X | X | | | X |
| ECOG Performance status | X | | X | | X | | | | | X |
| Needle Biopsy for biomarker assessments | | | | | | | X | | | |
| Tumor assessment | | | | | | | | X At end of even-numbered cycles. Prior to start of the next treatment cycle | | X |
| peptide 1 dosing | X | | X | | X | | | | | |
| Concomitant medications | X | X | X | X | X | X | X | | | X |
| FLT-PET provided that an evaluable FDG-PET-scan was performed prior to starting treatment | | | | | | | | | | |
| AE assessment | | | | | | | | | | |

TABLE 10-continued

Schedule of study activities through Cycle 2

| | Day 29 for DR-A and Day 22 DR-B of cycle/Day 1 of next cycle for patients continuing treatment ±3 d | | Day 8 of DR-A and Days 4 and 8 of DR-B ±1 d | | Day 15 of DR-A and Day 11 of DR-B ±1 d | | Day 16 DR-A and Day 12 of DR-B ±2 d | After even numbered cycles | CT Imaging* Prior to first dose | End-of-Study 30 ±3 d after last dose or study withdrawal |
|---|---|---|---|---|---|---|---|---|---|---|
| | Pre-dose | post-dose | pre-dose | Post-dose | pre-dose | post-dose | | | | |
| (begins at the point of the first peptide 1 infusion and continues until 30 days after last infusion) | X | X | X | X | X | X | X | | | X |

*All patients receive a CT image prior to the first dose. After dosing commences, in DR-A: CT images obtained at the end of Cycle 2 and every other cycle thereafter in DR-A, e.g., Cycles 4, 6, and 8 DR-B: CT images obtained after the last infusion in Cycle 3 and every third cycle thereafter in DR-B, e.g., Cycles 6, 9, and 12. Images are obtained after the last dose is administered in those cycles and prior to the Day 18 visit.

TABLE 11

Dose Regimen A - Study Activities Cycle 2 and Beyond

| (DR-A) | Day 29 of prior cycle/ Day 1 ±3 d | | Day 8 ±1 d | | Day 15 ±1 d | | Day 16 ±2 d | After even numbered cycles | End-of-Study 30 ±2 d after last dose or study withdrawal |
|---|---|---|---|---|---|---|---|---|---|
| | Pre-dose | Post-dose | Pre-dose | Post-dose | Pre-dose | Post-dose | | | |
| Serum or urine pregnancy | | | | | | | | | X |
| Vital signs | X | X | X | X | X | X | X | | X |
| Physical exam | X | | X | | X | | | | X |
| 12-lead ECG | X | X | | | | | | | X |
| Laboratory assessments | X | | X | | X | | X | | X |
| Collection of blood for immunogenicity | X | | | | | | | X | X |
| Blood Collection - biomarker assessments (each cycle) | X | X | | | X | X | X | | X |
| Blood Collection - PK assessments (Cycle 2 and End-of-Study only) | X | X | | | X | X | X | | X |
| ECOG Performance status | X | | X | | X | | | | X |
| Needle biopsy for biomarker assessments | | | | | | | X | | |
| CT Imaging | | | | | | | | X | X |
| peptide 1 dosing | X | | X | | X | | | | |
| Concomitant medications | X | X | X | X | X | X | X | | X |
| AE assessment | X | X | X | X | X | X | X | | X |

TABLE 12

Dose Regimen B - Study Activities Cycle 2 and Beyond

| (DR-B) | Day 23 of prior cycle/ Day 1 ±3 d Pre-dose | Day 1 Post-dose | Day 4 and 8 Pre-dose | Day 4 and 8 Post-dose | Day 11 Pre-dose | Day 11 Post-dose | Day 12 | After even numbered cycles | End-of-Study 30 ±2 d after last dose or study withdrawal |
|---|---|---|---|---|---|---|---|---|---|
| Serum or urine pregnancy | | | | | | | | | X |
| Vital signs | X | X | X | X | X | X | X | | X |
| Physical exam | X | | X | | X | | | | X |
| 12-lead ECG[3] | X | X | | | | | | | X |
| Laboratory assessments | X | | X | | X | | X | | X |
| Collection of blood for immunogenicity | X | | | | | | | X | X |
| Blood Collection - biomarker assessments (each cycle) | X | X | | | X | X | X | | X |
| Blood Collection - PK assessments (Cycle 2 and End-of-Study only) | X | X | | | X | X | X | | X |
| ECOG Performance status | X | | X | | X | | | | X |
| Needle biopsy for biomarker assessments | | | | | | | X | | |
| CT Imaging | | | | | | | | X | X |
| peptide 1 dosing | X | | X | | X | | | | |
| Concomitant medications | X | X | X | X | X | X | X | | X |
| AE assessment | X | X | X | X | X | X | X | | X |

Example 4: Pharmacokinetic Analysis

Levels of peptide 1 and its metabolites are measured in blood samples collected at specific time points described below. Pharmacokinetic data are tabulated and summarized by individual patient and collectively by dose level for each dose regimen. Graphical displays are provided where useful in the interpretation of results.

Blood samples for PK assessment are collected at the following time points:

TABLE 13

Time points for collection of blood samples for PK assessment

Cycle 1

| | |
|---|---|
| Day 1 DR-A and DR-B | within one hour before SOI EOI (+5 min) 30 min after EOI (±5 min) 1 hr after EOI (±5 min) 2 hr after EOI (±10 min) 4 hr after EOI (±10 min) 8 hr after EOI (±10 min) |
| Day 2 DR-A and DR-B | 24 hours (±4 hr) after SOI day prior |
| Day 3 DR-A and DR-B | 48 hours (±4 hr) after SOI Day 1 |
| Day 8, DR-A Days 4 & 8, DR-B | within one hour before SOI EOI (+5 min) 30 min after EOI (±5 min) 1 hr after EOI (±5 min) 2 hr after EOI (±10 min) 4 hr after EOI (±10 min) |
| Day 15, DR-A Day 11, DR-B | within one hour before SOI EOI (+5 min) 30 min after EOI (±5 min) 1 hr after EOI (±5 min) |

TABLE 13-continued

Time points for collection of blood samples for PK assessment

| | |
|---|---|
| Day 16, DR-A Day 12, DR-B | 2 hr after EOI (±10 min) 4 hr after EOI (±10 min) 8 hr after EOI (±10 min) 24 hours (±4 hrs) after SOI day prior |

Cycle 2

| | |
|---|---|
| Cycle 1 Day 29/ Cycle 2 Day 1, DR-A Cycle 1 Day 23/ Cycle 2 Day 1, DR-B | within one hour before SOI EOI (+5 min) 30 min after EOI (±5 min) 1 hr after EOI (±5 min) 2 hr after EOI (±10 min) 4 hr after EOI (±10 min) |

SOI stands for start of infusion of peptide 1; EOI stands for the end of infusion of peptide 1.

Example 5: Pharmacokinetic Study

Pharmacokinetic studies characterize exposure kinetics following single IV administrations of peptide 1 in mice, rats and monkeys, including evaluations of two different dosing formulations in rats and monkeys. Using qualified liquid chromatography with tandem mass spectrometry (LC-MS-MS) methods for efficacy models and dose range-finding (DRF) studies, and validated methods for GLP safety studies, absorption was characterized in mice at the MED in efficacy models and in rats and monkeys at tolerated and non-tolerated doses in toxicology studies. Exposures generally increased proportionally with dose, although an apparent plateau was observed at the highest dose of the 4-week monkey toxicology study. No sex-based differences were observed in either species, and no accumulation was observed following multiple doses.

The in vitro protein binding of peptide 1 was evaluated over a range of concentrations in mouse, rat and monkey plasma, as well as human plasma samples from normal subjects and hypoalbuminemic patients. Protein binding ranged from 92% to 98% in plasma of mice, rats, dogs, monkeys, and humans following incubation of peptide 1 at a single concentration of 2 µM, and exceeded 98% in mouse and rat plasma up 250 µM. In human and monkey plasma, free peptide 1 fractions of 3-4% were measured at peptide 1 concentrations up to 150 µM, corresponding to expected Cmax values from clinical doses up to 15 mg/kg, rising to 12-14% at concentrations >200 µM. In plasma from hypoalbuminemic patients, a similar rise was seen at >100 µM concentrations of peptide 1, corresponding to expected Cmax values from clinical doses up to 10 mg/kg. The concentration-dependent plasma protein binding is consistent with the plateau in exposure observed at the high-dose group (20 mg/kg) in the 4-week monkey GLP toxicity study, and suggests less-than-dose-proportional exposure at very high clinical doses, in particular for patients with hypoalbuminemia.

In vitro studies demonstrated a similar metabolite profile across species, including humans, providing support for the rat and the monkey as suitable species for toxicology studies. Proteolysis is the major biotransformation pathway of peptide 1. The predominant metabolite is a 3-amino acid truncation with the cyclic peptide portion intact, and the same metabolite profile was noted in in vitro stability studies with mouse, rat, monkey, and human cryopreserved hepatocytes. In a single-dose rat study, hepatobiliary metabolism and elimination represented the predominant clearance pathway for peptide 1, with the predominant metabolite being the major excretion product observed in the bile. The predominant metabolite was also observed in the plasma in both the rat and monkey 4-week GLP toxicity studies, with adequate exposures in these studies to provide characterization of its impact on the overall safety profile of peptide 1. In the monkey, the predominant metabolite plasma exposure was 10% of the predominant metabolite AUC, and in the rat, the predominant metabolite exposure was 6% of the peptide 1 AUC. Accumulation of the predominant metabolite was not observed with repeated twice-weekly dosing in rats or monkeys.

Inhibition or induction of cytochrome P450 (CYP) enzymes by peptide 1 appears to be negligible at clinically-relevant concentrations, although interactions are possible at high exposures of peptide 1 with drugs that are predominantly cleared by hepatobiliary transporters.

Example 6: Pharmacodynamic Analysis

Levels of p53, MDM2, MDMX, p21 and caspase are measured in liquid cancer cell specimens collected before beginning treatment and at the end of Cycle 1 or Cycle 2. MIC-1 is measured in blood samples. The specific time points for blood and tissue collection for PD assessments are described below. Pharmacodynamic data are tabulated and summarized by individual patient and collectively by dose level. Graphical displays are provided where useful in the interpretation of results.

Results available from previous genetic and biomarker tests, and additional tests of the blood and liquid cancer cell samples for biomarkers relevant to the safety and efficacy of peptide-1 can be investigated for possible correlation with patient outcome.

Blood samples for PD assessments are collected at the following time points:

TABLE 14

Time points for collection of blood samples for PD assessments

| Dose Regimens | Assessment | Blood Sample Collection Schedule |
|---|---|---|
| Cycle 1 DR-A, DR-B, or Both: | | |
| Day 1- Both (pre) | MIC-1 and CTC Samples | within 1 hour before the start of infusion (SOI) |
| Day 1- Both (post) | | EOI (+5 min) & EOI + 1 hr (±5 min), 2, 4, and 8 hr (±10 min) |
| Day 2- Both | | 24 hours (±4 hr) after SOI on Day 1 |
| Day 3- Both | | 48 hours (±4 hr) after SOI on Day 1 |
| Day 8 DR-A | | within 1 hour before SOI and |
| Day 4 & 8 DR-B | | within 1 hour after the end of infusion (EOI) |
| Day 15 DR-A | | within 1 hour before SOI and |
| Day 11 DR-B | | within 1 hour after EOI |
| Day 15 DR-A | | within 1 hour before SOI and |
| Day 11 DR-B | | EOI (+5 min) & EOI + 1 hr (±5 min), 2, 4, and 8 hr (±10 min) |
| Day 16 DR-A Day 12 DR-B | | 24 hours (±4 hrs) after SOI day prior |
| Day 22 DR-A Day 18 DR-B | | During Day visit |
| Each Subsequent Cycle Starting in Cycle (Cy) 2 | | |
| Cy 1 Day 29 DR-A | MIC-1 Only | within 1 hour before SOI and within 1 hour after EOI |
| Cy 1 Day 23 DR-B = Cycle 2 Day 1 | | |
| Day 15 DR-A | | within 1 hour before SOI and |
| Day 11 DR-B | | within 1 hour after EOI |
| Day 16 DR-A Day 12 DR-B | | 24 hours (±4 hrs) after SOI day prior |
| End of study visit | | During end of study visit |

NOTE:
no PD assessments for liquid lymphoma on Day 8 DR-A or Days 4 and 8 DR-B

Example 7: Assessment of Clinical Activity of the Peptidomimetic Macrocycle

To evaluate clinical activity, response rates and duration of response based on IWG (2014) criteria or other appropriate criteria are provided with a case-by-case description of all patients who exhibit CR, PR or SD. A descriptive analysis of other evidence of anti-liquid cancer cell activity or other clinical benefit is provided based on clinical, radiographic or other appropriate assessment of efficacy or clinical anti-liquid cancer cell activity. Analysis of clinical activity is conducted on two patient populations: (1) the subset of patients who receive at least one cycle of therapy and have at least one post-baseline disease assessment (the efficacy-evaluable population) and (2) a larger group of patients that includes the efficacy-evaluable population as well as patients who exhibit objective disease progression or experience a DLT and/or unacceptable toxicity prior to the end of Cycle 1.

Imaging scans, physical examination, and/or laboratory-based assays (e.g., prostate specific antigen) for patients with relevant disease indications are obtained at baseline (e.g., within 28 or 21 days of Cycle 1 Day 1), including, for example, a baseline PET-FDG and possibly FLT-PET scan(s) and for objective anti-liquid cancer cell activity as outlined below. The same type of imaging, physical examination, or laboratory-based assay procedure is used for each assessment for a patient. IWG (2014) criteria are used to assess liquid cancer response and duration of response. Scheduled scans (and/or other laboratory-based assay) are interpreted prior to the start of the next treatment cycle. If the criteria for a CR or PR are met, then the scan is repeated no earlier than within 4 weeks to confirm the response. A responding patient (CR, PR or SD) continues on study, with disease assessment after Cycle 2 and every other cycle thereafter in DR-A (e.g., Cycles 4 and 6) and after the last infusion in Cycle 3 and every third cycle thereafter in DR-B (e.g., Cycles 6 and 9), until disease progression, withdrawal of informed consent, or unacceptable toxicity.

Films or other records from imaging procedures, including those procedures performed at a regional or other facility outside of the primary institutions, are read and reviewed by the radiology staff at the corresponding primary study institution for the patient.

[$^{18}$F]-fluorodeoxyglucose positron emission tomographic (FDG-PET) imaging is performed at baseline using using IWG (2014) criteria for patients with liquid lymphoma. FDG-PET imaging post-baseline is only performed in patients at the first occurrence of stable disease as an adjunct to determine anti-liquid cancer cell activity. PET/CT scans can substitute for contrast-enhanced CT scans provided the CT performed as part of a PET-CT is of similar diagnostic quality as a diagnostic CT with IV and oral contrast.

FLT-PET imaging is performed at baseline for patients with liquid cancer cells commonly showing sufficient uptake of FLT tracer, e.g., patients with liquid lymphoma and other liquid cancers.

DR-A assigned patients who demonstrate a standard uptake value (SUV) of ≥5 at baseline will have a repeat FLT image one day after their last infusion of study medication in Cycle 1, i.e., Day 16.

DR-B patients who demonstrate a standard uptake value (SUV) of ≥5 at baseline will have a repeat FLT image one day after their last infusion of study medication in Cycle 1, i.e., Day 12.

Example 8: Molecular Screening Prior to Day 1 of Cycle 1

Molecular screening encompasses the following prior to the first administration of peptide 1 (Day 1 of Cycle 1).
Collection of signed informed consent for molecular screening
Collection of an archived liquid cancer cell sample or a fresh liquid cancer cell biopsy (unless a biopsy poses significant clinical risk) for p53 testing
If confirmed to be p53 WT, the remainder of the tissue sample from enrolled patients are used to test for PD biomarkers
Confirmation of p53 WT status before administration of the first dose of peptide 1 is mandatory for enrollment in:
Stage 1 of DEP for patients starting at Dose Level 4 and higher
Stage 2 (if necessary) of DEP and EXP for all patients
At Dose Level 4 and higher in Stage 1 of the DEP (as well as for all patients enrolled in Stage 2 of the DEP), molecular screening in patients with unknown p53 status is done prior to initiating the clinical screening. If the p53 status is known to be WT, these patients can proceed to clinical screening and can be enrolled and receive peptide 1 before confirmation of p53 WT by the central laboratory.
In the EXP, patients must have completed molecular screening at the central laboratory prior to proceeding to enrolment. These patients can only be enrolled and receive peptide 1 after confirmation of p53 WT by the central laboratory.

Example 9: Management of Tumor Lysis Syndrome (TLS)

There is a potential for tumor lysis syndrome (TLS) in patients with liquid lymphoma, especially those with large liquid cancer cell burden, pre-dose elevated lactate dehydrogenase and leukocyte counts, renal dysfunction, or dehydration. TLS can be caused by treatment-induced abrupt cancer cell disintegration. It is usually observed shortly after initiating treatment. Patients at risk for TLS can receive liquid cancer cell lysis prophylaxis as part of standard of care according to local clinical protocols.

Laboratory TLS is defined as a 25% increase in the levels of serum uric acid, potassium, or phosphorus or a 25% decrease in calcium levels. Therefore, patients are monitored for these laboratory parameters 24 hours (Day 2) after infusion of peptide 1 on Day 1 in DR-A and DR-B during Cycle 1. Signs and symptoms of TLS are monitored until resolved.

Example 10: Multiplexed Cytotoxicity Assay

The objective of this study was to concurrently evaluate peptide 1-induced cytotoxicity, p21 up-regulation and caspase-3 activation in multiple liquid cancer cell cell lines characterized as having either wild-type or mutated p53 in order to determine whether the cytotoxicity is PD-mediated.

Cell lines from hematologic liquid cancer cells, characterized for p53 mutant/wild-type status, were seeded into 384-well plates and incubated in a humidified atmosphere of 5% $CO_2$ at 37° C. Peptide 1 was serially diluted and assayed over 10 concentrations, up to 30 µM, in a final assay concentration of 0.1% DMSO. Treatment was added 24 hours post cell seeding, when a time zero untreated cell plate was also generated to determine the number of doublings in the 72 hour assay period. About one hundred cells per well were evaluated, with each test condition run in duplicate wells. After a 72 hour incubation period, cells were fixed and stained with fluorescently labeled antibody and nuclear dye. In the same wells, nuclei were assessed for toxicity (dye uptake) by automated fluorescence microscopy; apoptosis was assayed by elevations in anti-active caspase-3 antibody; and cell cycle arrest was assayed by elevations in anti-p21 monoclonal antibody EA10. Characteristics of the 32 hematologic cell lines evaluated in this study are listed in Table 15.

TABLE 15

Hematologic Tumor Cell Lines Evaluated for Cytotoxicity and for Induction of Caspase and p21 following 72-Hour Incubations with peptide 1

| Mutant p53 | | Wild-Type p53 | |
| --- | --- | --- | --- |
| Cell Line | Tumor Origin | Cell Line | Tumor Origin |
| J-RT3-T3-5 | Leukemia | MOLT-3 | Leukemia |
| MEG01 | Leukemia | CML-T1 | Leukemia |
| CCRFCEM | Leukemia | MV-4-11 | Leukemia |
| MHH-PREB-1 | Leukemia | BV-173 | Leukemia |
| K562 | Leukemia | NALM-6 | Leukemia |
| EM-2 | Leukemia | SR | Lymphoma |
| CEM-C1 | Leukemia | Daudi | Lymphoma |
| Thp1 | Leukemia | DOHH-2 | Lymphoma |
| Jurkat | Leukemia | CRO-AP2 | Lymphoma |
| HEL-92-1-7 | Leukemia | RPMI 6666 | Lymphoma |
| MOLT-16 | Leukemia | BC-1 | Lymphoma |
| DB | Lymphoma | | |
| L-428 | Lymphoma | | |
| Ramos (RA 1) | Lymphoma | | |
| HT | Lymphoma | | |
| ST486 | Lymphoma | | |
| Raji | Lymphoma | | |
| EB-3 | Lymphoma | | |
| RPMI 8226 | Myeloma | | |
| ARH-77 | Myeloma | | |
| U266B1 | Myeloma | | |

Cell proliferation was measured by relative cell count, which was expressed as percent of control. The activated caspase-3 marker labels cells from early to late stage apoptosis, and output is shown as a fold increase of apoptotic cells over vehicle background normalized to the relative cell count in each well (Emax); a ≥5-fold induction indicates significant induction of apoptosis. For example, peptide 1 was able to induce robust apoptotic responses in p53 wild-type hematopoietic cell lines (see FIG. 2).

Figure 3:
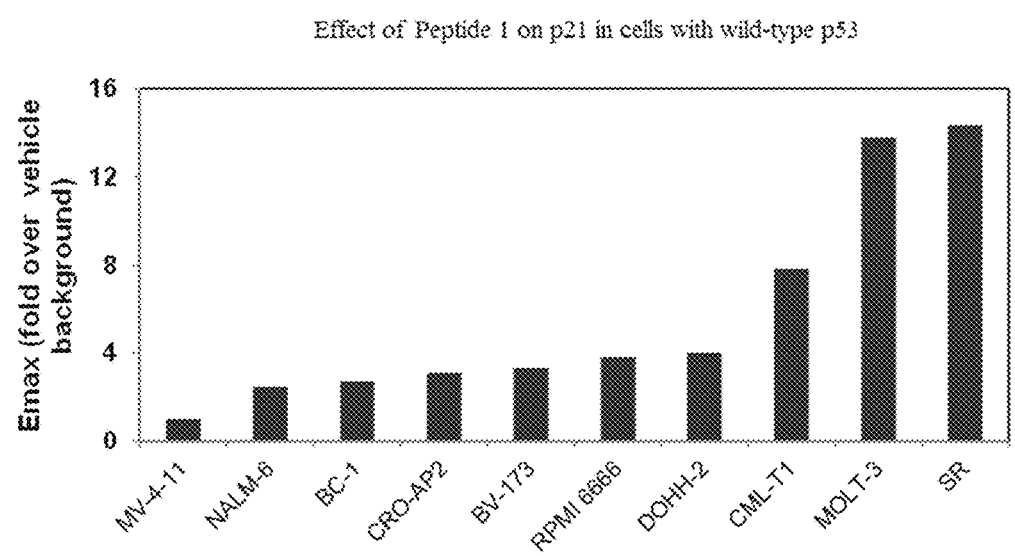
FIG. 3 shows peptide 1 yielded on-mechanism p21 pharmacodynamic responses in p53 wild-type hematopoietic cell lines.

Total p21 level indicates relative activity of p53, and output is shown as a fold induction of p21 concentrations over vehicle background normalized to the relative cell count in each well (Emax); a ≥2-fold increase or decrease in total p21 protein per cell is considered significant. For example, peptide 1 was able to show significant induction of p21 and yielded on-mechanism p21 pharmacodynamic responses in p53 wild-type hematopoietic cell lines (see FIG. 3).

For each cell line, an $EC_{50}$ estimated the concentration at which 50% of the cells were killed. Additional parameters that characterized the responses include $IC_{50}$ (peptide 1 concentration at 50% maximal possible response), $GI_{50}$ (concentration need to reduce growth by 50%), and activity area (the integrated area over the survival curve). For example, proliferation and survival of cell lines with wild-type p53 protein was sensitive to peptide 1, with $IC_{50}$ values ranging from 0.2 to 3.3 µM. Not all cell lines exhibited cytotoxicity at the peptide 1 concentrations tested. Those that did were most often characterized by significant inductions of both caspase-3 and p21. Results with BV-173 leukemia cells (Table 16) are representative of the typical responses with these cell lines.

TABLE 16

Apoptotic Cytotoxicity in Wild Type P53-Containing BV-173 Tumor Cells

| Conc. | Relative Cell Count (%) | | Caspase Fold Induction | | p21 Fold Change | |
|---|---|---|---|---|---|---|
| (µM) | Mean | SD | Mean | SD | Mean | SD |
| 9.55E−04 | 100.8 | 2.7 | 1.1 | 0.2 | 1.1 | 0.1 |
| 3.02E−03 | 99.9 | 4.5 | 1.1 | 0.3 | 1.0 | 0.1 |
| 9.53E−03 | 94.9 | 0.9 | 1.2 | 0.2 | 1.0 | 0.1 |
| 3.01E−02 | 84.8 | 2.8 | 1.4 | 0.2 | 1.0 | 0.1 |
| 9.52E−02 | 64.4 | 2.9 | 2.4 | 0.7 | 1.1 | 0.2 |
| 3.01E−01 | 31.8 | 2.3 | 4.1 | 1.0 | 1.3 | 0.1 |
| 9.51E−01 | 14.3 | 0.3 | 6.3 | 1.1 | 2.3 | 0.3 |
| 3.00E+00 | 15.0 | 8.3 | 3.7 | 2.0 | 3.3 | 0.9 |
| 9.49E+00 | 4.3 | 0.5 | N/A | N/A | N/A | N/A |
| 3.00E+01 | 2.2 | 1.1 | N/A | N/A | N/A | N/A |

Cytotoxicity in liquid cancer cell lines with mutant p53, when observed, was most often characterized by significant induction of p21 without significant caspase-3 induction. Results with HEL-92-1-7 leukemia cells (Table 17) are representative of the typical responses with these cell lines.

TABLE 17

Non-Apoptotic Cytotoxicity in Mutant P53-Containing HEL-92-1-7 Tumor Cells

| Conc. | Relative Cell Count (%) | | Caspase Fold Induction | | p21 Fold Change | |
|---|---|---|---|---|---|---|
| (µM) | Mean | SD | Mean | SD | Mean | SD |
| 9.55E−04 | 98.5 | 4.9 | 1.2 | 0.2 | 1.3 | 0.2 |
| 3.02E−03 | 96.8 | 6.3 | 1.2 | 0.1 | 1.5 | 0.1 |
| 9.53E−03 | 98.2 | 2.6 | 1.1 | 0.1 | 1.7 | 0.2 |
| 3.01E−02 | 89.8 | 1.7 | 1.0 | 0.1 | 2.2 | 0.2 |
| 9.52E−02 | 89.7 | 2.6 | 1.0 | 0.2 | 2.9 | 0.0 |
| 3.01E−01 | 77.8 | 2.3 | 1.1 | 0.1 | 3.2 | 0.1 |
| 9.51E−01 | 81.9 | 7.7 | 1.1 | 0.2 | 3.7 | 0.3 |
| 3.00E+00 | 79.2 | 4.3 | 1.1 | 0.1 | 3.9 | 0.4 |
| 9.49E+00 | 76.9 | 1.8 | 0.7 | 0.1 | 4.4 | 0.7 |
| 3.00E+01 | 67.9 | 5.1 | 0.6 | 0.1 | 4.2 | 0.6 |

Using an $EC_{50}$ cut-off of 1 µM for all hematologic liquid cancer cell lines, induction of apoptosis was found to have very good agreement with the p53 status of the cells (Table 18). Therefore, p53 status can be a sensitive biomarker for testing cytotoxicity of compounds, such as peptide 1.

TABLE 18

Sensitivity of Tumor Cells Containing Wild-Type and Mutant p53 to peptide 1-Induced Cytotoxicity

| $EC_{50}$ for Cytotoxicity | Wild Type p53 | Mutant p53 |
|---|---|---|
| >1 µM | 11 | 160 |
| ≤1 µM | 60 | 2 |

Figure 4:
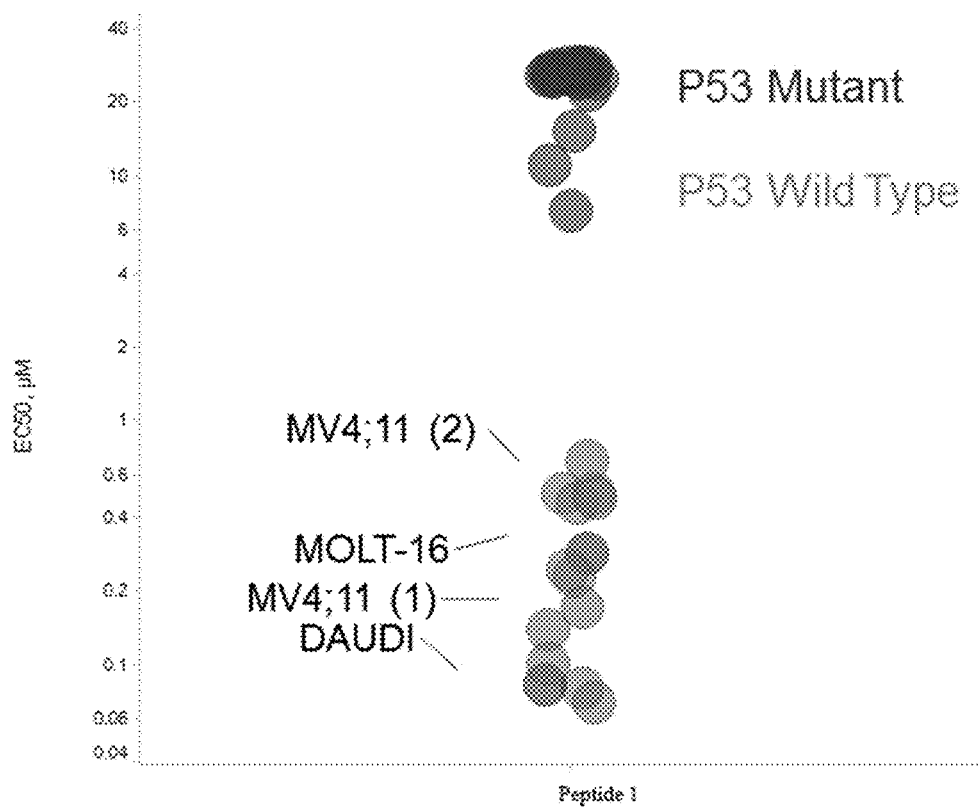
FIG. 4 shows peptide 1 selectively killed p53 wild-type cancer cells in a representative hematopoietic cell line panel.

Peptide 1 selectively induced p53-mediated apoptotic cell death in liquid cancer cell lines (e.g. hematopoietic cancer cells) containing wild-type p53 protein. As shown in FIG. 4, all eleven p53 WT (6 lymphoma and 5 leukemia) hematologic cancer cell lines were highly sensitive to peptide 1 intervention as all lines exhibited $EC_{50}$ less than 0.6 µM. Taken together, these lines of evidence suggested effectiveness of peptide 1 against liquid tumor cell lines across multiple histological origins that retain the p53 WT status. In liquid cancer cell lines containing mutated p53, cytotoxicity was associated with cell cycle arrest without elevated apoptosis. These findings demonstrate the pharmacodynamic selectivity of peptide 1 towards liquid cancer cells with active wild-type p53.

Example 11: The Effect of Peptide 1 on Tumor Growth Inhibition

Figure 5:
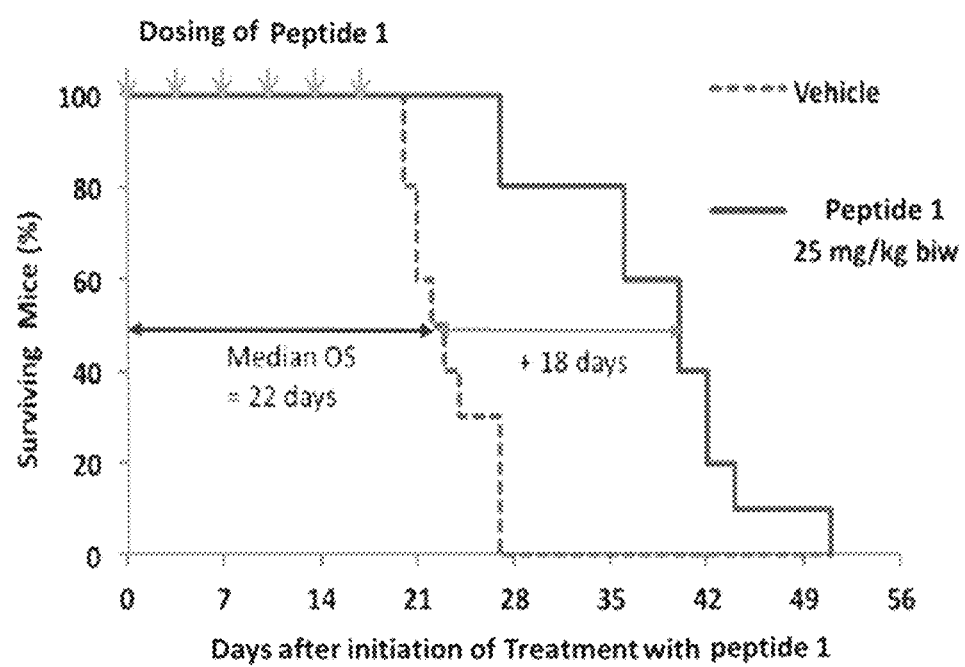
FIG. 5 shows survival of animals after dosing of peptide 1 in AML xenograft model.

In another study, MV 4;11 human leukemia xenograft model was used in mice to assess the ability of peptide 1 to inhibit tumor growth and improve overall survival in AML, a highly aggressive liquid tumor. In this study, 25 mg/kg dose of peptide 1 was administered in six bi-weekly doses and compared to the results of mice treated with only cyclophosphamide, the control group. Mice were monitored individually for an endpoint of morbidity due to progression of the leukemia. All ten mice that received the control exited the study between days 21 and 28, offering a sensitive assay for activity. As shown in FIG. 5, treatment with peptide 1 resulted in median overall survival of 40 days as compared to 22 days for untreated mice, an 81% increase for those receiving peptide 1. Peptide 1 can have an effect in liquid tumors with WT p53 and in AML.

Example 12: The Safety and Toxicology of Peptide 1

The 4-week multiple-dose GLP studies in rats and monkeys utilized twice-weekly IV dosing of peptide 1. The studies provided dose- and exposure-related assessments during both dosing and recovery periods, and results were utilized to define the maximum tolerated doses (MTD) and estimate the severely toxic dose for 10% ($STD_{10}$) of rats and the highest non-severely toxic dose (HNSTD) in monkeys. All gross and microscopic signs of intolerance (e.g., reduced organ weights, sporadic findings of multi-tissue hemorrhage and hepatic necrosis) and changes in serum chemistry parameters were considered as secondary to red blood cell (RBC), platelet and/or white blood cell (WBC) depletions or anorexia and dehydration in both species. Recovery assessments revealed regenerative and compensatory changes consistent with marrow cell survival and reversibility of all related hematologic and secondary toxicities.

Figure 6:
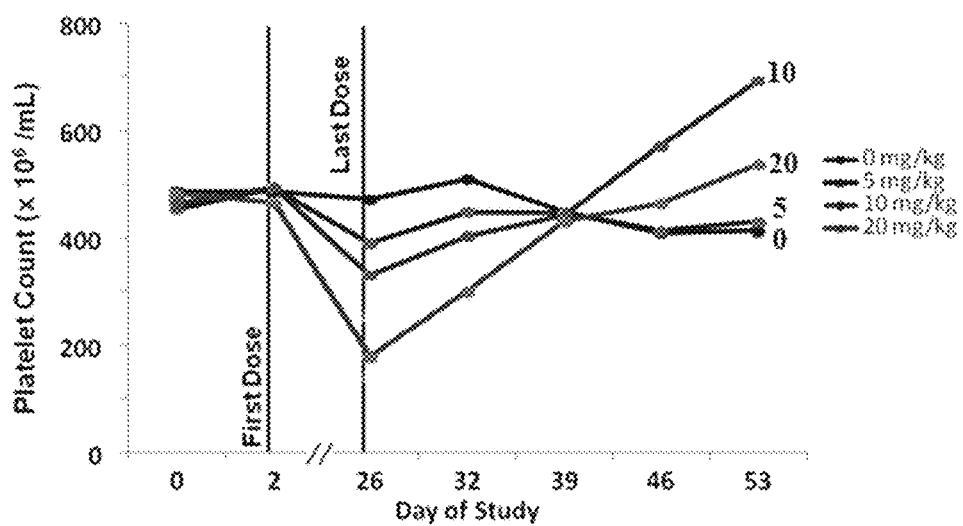
FIG. 6 shows the dose-dependant platelet response of peptide 1 in 4-week monkey GLP toxicity study.

The dose limiting toxicities (DLT) in both animal species appears to be related to the suppression of hematopoietic cells in the bone marrow, in particular cells of the megakaryocyte lineage, resulting in significant decreases in peripheral blood platelets that demonstrated recovery upon the cessation of dosing. For example, dose-dependent decreases in platelets with recovery were shown in a representative 4-week monkey GLP toxicity study using different dosings of peptide 1 (see FIG. 6).

The $STD_{10}$ in rats was determined at 10 mg/kg based on the mortality of one animal in a satellite group for hematology sampling during recovery. The HNSTD in monkeys was determined at 5 mg/kg, based on a complete lack of significant thrombocytopenia at this lowest dose level. However, almost all of the monkeys at the mid- and high-dose levels tolerated peptide 1 administration well; only one animal at each of these dose levels developed significant thrombocytopenia ($<100,000 \times 10^6$/ml).

Rats were more sensitive to the bone marrow and hematologic effects of peptide 1 than monkeys on the basis of exposures at maximally tolerated doses. Exposure at rat $STD_{10}$ ($AUC_{0-\infty}$=562 µg·hr/mL at 10 mg/kg) was below that of HNSTD in monkeys ($AUC_{0-\infty}$=813 µg·hr/mL at 5 mg/kg). These in vivo results correlated with those obtained from in vitro hemotoxicity assays via luminescence output (HALO). In these investigations, peptide 1 in general inhibited the induced proliferation of bone marrow precursor cells from rats to a greater extent than those from monkeys or humans. $IC_{50}$ values were ~2- to 8-fold higher for rat cells than for monkey or human cells, with the largest difference noted for megakaryocyte colony forming cells, the platelet precursors. These results correlated with in vivo findings indicating that rats are more sensitive to the bone marrow and hematologic effects of peptide 1 than monkeys on the basis of dose and exposures at maximally tolerated doses. These results also suggested that, in terms of projecting potential bone marrow and hematological toxicity levels in humans, the monkey PK-PD data can be more clinically relevant than the rat data.

Peptide 1 was negative in genetic toxicology studies, including bacterial mutagenicity (Ames), chromosomal aberrations (human peripheral blood lymphocyte) and in vivo micronucleus (rat bone marrow) assays. Safety pharmacology studies were performed to assess the effects of peptide 1 on hERG potassium channels in vitro and on cardiac function in cynomolgus monkeys.

The above studies demonstrated that peptide 1 showed a favorable profile in preclinical GLP safety studies in rodents and monkeys. Genotoxicity, gastrointestinal toxicity, cardiotoxicity, and immunogenicity were not observed. Histopathology showed bone marrow hypocellularity consistent with mild to moderate myelosuppression.

Example 13: Pharmacokinetics of Peptide 1

In rats, peptide 1 generally showed linear, dose-proportional increases in $C_{max}$ and AUC. In the 4-week rat GLP toxicity study, $C_m$ax of peptide 1 ranged from 49.9 to 186 µg/mL, $AUC_{0-\infty}$, ranged from 90.5 to 562 µg*hr/mL, and clearance ranged from 19.2 to 28.3 mL/hr/kg.

In non-human primates, peptide 1 generally showed exposures that increased proportionally with dose, although an apparent plateau in exposure was observed at the high-dose group (20 mg/kg) in the 4-week monkey GLP toxicity study. In the study, $C_{max}$ of Aileron peptide 1 ranged from 133 to 562 µg/mL, $t_{1/2}$ ranged from 3.7 to 6.0 hrs, $AUC_{0-\infty}$ ranged from 813 to 1,600 µg·hr/mL, and clearance ranged from 6.5 to 13.8 mL/hr/kg.

No significant sex-based differences in PK parameters were observed in either rats or monkeys, and no accumulation was observed following repeated doses on a twice-weekly schedule in the GLP toxicity studies.

In vitro studies revealed that peptide 1 is not an inhibitor of any cytochrome P450 (CYP) isoforms tested. In vitro assays for CYP induction also did not indicate any significant treatment-related effects with peptide 1. Based on these findings, the potential of clinically relevant drug-drug interactions for concomitant medications that are cleared through CYP-mediated mechanisms can be low.

SEQUENCE LISTING (1501 sequences)

SEQ ID NO: 1-7 - skipped (7 entries)

SEQ ID NO: 8 - protein, 10 aa, Artificial Sequence
  Description of Artificial Sequence: Synthetic peptide
  MOD_RES (2)..(2): Any amino acid
  MOD_RES (9)..(9): Any amino acid
  see specification as filed for detailed description of substitutions and preferred embodiments
FXHYWAQLXS

SEQ ID NO: 9 - protein, 10 aa, Artificial Sequence
  Description of Artificial Sequence: Synthetic peptide
  MOD_RES (2)..(2): Any amino acid
  MOD_RES (8)..(8): Leu or Cba
  MOD_RES (9)..(9): Any amino acid
  see specification as filed for detailed description of substitutions and preferred embodiments
FXEYWAQXXA

SEQ ID NO: 10 - protein, 12 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAAA

SEQ ID NO: 11 - protein, 12 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (11)..(11): 2-aminoisobutyric acid
  C-term NH2
FAAYWEXLAAXA

SEQ ID NO: 12 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLASAL

SEQ ID NO: 13 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASAL

SEQ ID NO: 14 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASAM

SEQ ID NO: 15 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): hLeu
  C-term NH2
LTFAAYWAQLASAL

SEQ ID NO: 16 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASAF

SEQ ID NO: 17 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASAI

SEQ ID NO: 18 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Cyclohexyl-Gly
  C-term NH2
LTFAAYWAQLASAG

SEQ ID NO: 19 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): 2-aminoisobutyric acid
  C-term NH2
LTFAAYWAQLASAX

SEQ ID NO: 20 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASAA

SEQ ID NO: 21 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(9): Crosslink between residues
  MOD_RES (9)..(9): Alpha-Me S5-pentenyl-alanine olefin amino acid connected by an all-carbon crosslinker comprising one double bond
  MOD_RES (11)..(11): Alpha-Me S5-pentenyl-alanine olefin amino acid connected by an all-carbon crosslinker comprising one double bond
  misc_feature (11)..(13): Crosslink between residues
  MOD_RES (13)..(13): Alpha-Me S5-pentenyl-alanine olefin amino acid connected by an all-carbon crosslinker comprising one double bond
  MOD_RES (14)..(14): Norleucine
  C-term NH2
LTFAAYWAALASAL

SEQ ID NO: 22 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(9): Crosslink between residues
  MOD_RES (9)..(9): Alpha-Me S5-pentenyl-alanine olefin amino acid connected by an all-carbon crosslinker comprising one double bond
  MOD_RES (11)..(11): Alpha-Me S5-pentenyl-alanine olefin amino acid connected by an all-carbon crosslinker comprising one double bond
  misc_feature (11)..(13): Crosslink between residues
  MOD_RES (13)..(13): Alpha-Me S5-pentenyl-alanine olefin amino acid connected by an all-carbon crosslinker comprising one double bond
  C-term NH2
LTFAAYWAALASAA

SEQ ID NO: 23 - protein, 12 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (12)..(12): Norleucine
  C-term NH2
FAAYWEXLAAAL

SEQ ID NO: 24 - protein, 12 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAAL

SEQ ID NO: 25 - protein, 12 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAAM

SEQ ID NO: 26 - protein, 12 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (12)..(12): hLeu
  C-term NH2
FAAYWEXLAAAL

SEQ ID NO: 27 - protein, 12 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAAF

SEQ ID NO: 28 - protein, 12 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAAI

SEQ ID NO: 29 - protein, 12 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (12)..(12): Cyclohexyl-Gly
  C-term NH2
FAAYWEXLAAAG

SEQ ID NO: 30 - protein, 12 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (12)..(12): Cyclohexyl-Ala
  C-term NH2
FAAYWEXLAAAA

SEQ ID NO: 31 - protein, 12 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (12)..(12): 2-aminoisobutyric acid
  C-term NH2
FAAYWEXLAAAX

SEQ ID NO: 32 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): 2-aminoisobutyric acid
  C-term NH2
LTFAAYWAQLAAAXV

SEQ ID NO: 33 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): 2-aminoisobutyric acid
  C-term NH2
LTFAAYWAQLAAAXV

SEQ ID NO: 34 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): 2-aminoisobutyric acid
  C-term NH2
LTFAAYWAQLASXAA

SEQ ID NO: 35 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): 2-aminoisobutyric acid
  C-term NH2
LTFAAYWAQLASXAA

SEQ ID NO: 36 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(16): Norleucine
  C-term NH2
HLTFAHHWHQLAAALL

SEQ ID NO: 37 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
DLTFAHHWHQLARRLV

SEQ ID NO: 38 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
HHTFAHHWHQLAAAML

SEQ ID NO: 39 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): Cyclohexyl-Ala
  C-term NH2
FAHHWHQLARRDA

SEQ ID NO: 40 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAHHWHQLAHRFV

SEQ ID NO: 41 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): hLeu
  C-term NH2
HLTFAHHWHQLAAALA

SEQ ID NO: 42 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): Cyclohexyl-Gly
  MOD_RES (16)..(16): D-amino acid
  C-term NH2
DLTFAHHWHQLARRGL

SEQ ID NO: 43 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): Cyclohexyl-Gly
  MOD_RES (16)..(16): D-amino acid
  C-term NH2
DLTFAHHWHQLARRGL

SEQ ID NO: 44 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): Cyclohexyl-Ala
  MOD_RES (16)..(16): D-amino acid
  C-term NH2
HHTFAHHWHQLAAAAV

SEQ ID NO: 45 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): D-amino acid
  C-term NH2
FAHHWHQLARRDA

SEQ ID NO: 46 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (12)..(12): 2-aminoisobutyric acid
  C-term NH2
FAHHWHQLAHRXG

SEQ ID NO: 47 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (12)..(12): Norleucine
  C-term NH2
FAAYWAQLAHHLL

SEQ ID NO: 48 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): Norleucine
  C-term NH2
FAAYWSALAHQAL

SEQ ID NO: 49 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (12)..(12): Cyclohexyl-Gly
  MOD_RES (13)..(13): D-amino acid
  C-term NH2
FAAYWVQLAQHGL

SEQ ID NO: 50 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (12)..(12): Norleucine
  MOD_RES (13)..(13): D-amino acid
  C-term NH2
FAAYWTALAQQLV

SEQ ID NO: 51 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (11)..(11): 2-aminoisobutyric acid
  MOD_RES (13)..(13): D-amino acid
  C-term NH2
FAAYWYQLAHXAA

SEQ ID NO: 52 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAHHLA

SEQ ID NO: 53 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAHHLA

SEQ ID NO: 54 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
LTFAAYWAQLAHQLV

SEQ ID NO: 55 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
LTFAAYWAQLAHQLV

SEQ ID NO: 56 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAQQML

SEQ ID NO: 57 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAQQML

SEQ ID NO: 58 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): 2-aminoisobutyric acid
  MOD_RES (14)..(14): hLeu
  C-term NH2
LTFAAYWAQLAHXLV

SEQ ID NO: 59 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAAHFA

SEQ ID NO: 60 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): Norleucine
  MOD_RES (16)..(16): D-amino acid
  C-term NH2
HLTFAHHWHQLAAALL

SEQ ID NO: 61 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (16)..(16): D-amino acid
  C-term NH2
DLTFAHHWHQLARRLA

SEQ ID NO: 62 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (16)..(16): D-amino acid
  C-term NH2
HHTFAHHWHQLAAAMV

SEQ ID NO: 63 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAHHWHQLARRDA

SEQ ID NO: 64 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): Cyclohexyl-Ala
  C-term NH2
FAHHWHQLAHRFA

SEQ ID NO: 65 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NHAm
FAAYWEALAAA

SEQ ID NO: 66 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NHiAm
FAAYWEALAAA

SEQ ID NO: 67 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NHnPr3Ph
FAAYWEALAAA

SEQ ID NO: 68 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NHnBu33Me
FAAYWEALAAA

SEQ ID NO: 69 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NHnPr
FAAYWEALAAA

SEQ ID NO: 70 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NHnEt2Ch
FAAYWEALAAA

SEQ ID NO: 71 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NHnEt2Cp
FAAYWEALAAA

SEQ ID NO: 72 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NHHex
FAAYWEALAAA

SEQ ID NO: 73 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAAAIA

SEQ ID NO: 74 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAAAIA

SEQ ID NO: 75 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAALAAAMA

SEQ ID NO: 76 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAALAAAMA

SEQ ID NO: 77 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 78 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 79 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAIA

SEQ ID NO: 80 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAIA

SEQ ID NO: 81 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAALAAAMA

SEQ ID NO: 82 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAALAAAMA

SEQ ID NO: 83 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
LTFAAYWAQLAAALA

SEQ ID NO: 84 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
LTFAAYWAQLAAALA

SEQ ID NO: 85 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAALAAAIV

SEQ ID NO: 86 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAALAAAIV

SEQ ID NO: 87 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAMV

SEQ ID NO: 88 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
LTFAAYWAALAAALV

SEQ ID NO: 89 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
LTFAAYWAALAAALV

SEQ ID NO: 90 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAIL

SEQ ID NO: 91 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAIL

SEQ ID NO: 92 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAALAAAML

SEQ ID NO: 93 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
LTFAAYWAQLAAALL

SEQ ID NO: 94 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
LTFAAYWAQLAAALL

SEQ ID NO: 95 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEALAAAMA

SEQ ID NO: 96 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (12)..(12): Norleucine
  C-term NH2
FAAYWEALAAALA

SEQ ID NO: 97 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): D-amino acid
  C-term NH2
FAAYWEALAAAIA

SEQ ID NO: 98 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): D-amino acid
  C-term NH2
FAAYWEALAAAMA

SEQ ID NO: 99 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (12)..(12): Norleucine
  MOD_RES (13)..(13): D-amino acid
  C-term NH2
FAAYWEALAAALA

SEQ ID NO: 100 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): D-amino acid
  C-term NH2
FAAYWEALAAAIV

SEQ ID NO: 101 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): D-amino acid
  C-term NH2
FAAYWEALAAAMV

SEQ ID NO: 102 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (12)..(12): Norleucine
  MOD_RES (13)..(13): D-amino acid
  C-term NH2
FAAYWEALAAALV

SEQ ID NO: 103 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): D-amino acid
  C-term NH2
FAAYWEALAAAIL

SEQ ID NO: 104 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): D-amino acid
  C-term NH2
FAAYWEALAAAML

SEQ ID NO: 105 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (12)..(12): Norleucine
  MOD_RES (13)..(13): D-amino acid
  C-term NH2
FAAYWEALAAALL

SEQ ID NO: 106 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (12)..(12): Norleucine
  MOD_RES (13)..(13): D-amino acid
  C-term NH2
FAAYWEALAAALL

SEQ ID NO: 107 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (11)..(11): Alpha-Me S5-pentenyl-alanine olefin amino acid connected by an all-carbon crosslinker comprising one double bond
  C-term NH2
LTFAAYWAQLASAA

SEQ ID NO: 108 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (11)..(11): Alpha-Me S5-pentenyl-alanine olefin amino acid connected by an all-carbon crosslinker comprising one double bond
  C-term NH2
LTFAAYWAQLASAA

SEQ ID NO: 109 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
WTFAFYWSQLAAVAA

SEQ ID NO: 110 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
WTFAFYWSQLAAVAA

SEQ ID NO: 111 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFAVYWSQLAAVA

SEQ ID NO: 112 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFAVYWSQLAAVA

SEQ ID NO: 113 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
WTFAFYWSQLASAAA

SEQ ID NO: 114 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
WTFAFYWSQLASAAA

SEQ ID NO: 115 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(16): D-amino acid
  C-term NH2
WTFAVYWSQLAAVAAA

SEQ ID NO: 116 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(16): D-amino acid
  C-term NH2
WTFAVYWSQLAAVAAA

SEQ ID NO: 117 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAAVG

SEQ ID NO: 118 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAAVG

SEQ ID NO: 119 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAAVQ

SEQ ID NO: 120 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAAVQ

SEQ ID NO: 121 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): D-amino acid
  C-term NH2
LTFAAYWAQLASAA

SEQ ID NO: 122 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): D-amino acid
  C-term NH2
LTFAAYWAQLASAA

SEQ ID NO: 123 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWAQLASAA

SEQ ID NO: 124 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWAQLASAA

SEQ ID NO: 125 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Two pentenyl-alanine olefin side chains, each of which is crosslinked to another amino acid as indicated
  misc_feature (11)..(14): Crosslink between residues
  MOD_RES (14)..(14): Alpha-Me S5-pentenyl-alanine olefin amino acid connected by an all-carbon crosslinker comprising one double bond
  C-term NH2
LTFAAYWEQLASAA

SEQ ID NO: 126 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASLA

SEQ ID NO: 127 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASLA

SEQ ID NO: 128 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASWA

SEQ ID NO: 129 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASWA

SEQ ID NO: 130 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASVS

SEQ ID NO: 131 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASAS

SEQ ID NO: 132 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASVG

SEQ ID NO: 133 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): D-amino acid
  C-term NH2
ETFAVYWAQLASAA

SEQ ID NO: 134 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAVYWAQLASAA

SEQ ID NO: 135 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAVYWAQLASVA

SEQ ID NO: 136 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAVYWAQLASLA

SEQ ID NO: 137 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAVYWAQLASWA

SEQ ID NO: 138 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAKYWAQLASWA

SEQ ID NO: 139 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAVYWAQLASVS

SEQ ID NO: 140 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAVYWAQLASAS

SEQ ID NO: 141 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAVYWAQLASVG

SEQ ID NO: 142 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): D-amino acid
  C-term NH2
LTFAVYWAQLASSA

SEQ ID NO: 143 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): D-amino acid
  C-term NH2
ETFAVYWAQLASSA

SEQ ID NO: 144 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): D-amino acid
  C-term NH2
LTFAVYWAQLASNA

SEQ ID NO: 145 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): D-amino acid
  C-term NH2
ETFAVYWAQLASNA

SEQ ID NO: 146 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): D-amino acid
  C-term NH2
LTFAVYWAQLASAA

SEQ ID NO: 147 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLASVA

SEQ ID NO: 148 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLASVA

SEQ ID NO: 149 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLASWA

SEQ ID NO: 150 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLASVS

SEQ ID NO: 151 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLASVS

SEQ ID NO: 152 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLASAS

SEQ ID NO: 153 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLASAS

SEQ ID NO: 154 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLASVG

SEQ ID NO: 155 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLASVG

SEQ ID NO: 156 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Ala
  MOD_RES (11)..(11): Alpha-Me S5-pentenyl-alanine olefin amino acid connected by an all-carbon crosslinker comprising one double bond
  C-term NH2
LTFAEYWAQAASAA

SEQ ID NO: 157 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Ala
  MOD_RES (11)..(11): Alpha-Me S5-pentenyl-alanine olefin amino acid connected by an all-carbon crosslinker comprising one double bond
  C-term NH2
LTFAEYWAQAASAA

SEQ ID NO: 158 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclopentyl-Gly
  MOD_RES (11)..(11): Alpha-Me S5-pentenyl-alanine olefin amino acid connected by an all-carbon crosslinker comprising one double bond
  C-term NH2
LTFAEYWAQGASAA

SEQ ID NO: 159 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclopentyl-Gly
  MOD_RES (11)..(11): Alpha-Me S5-pentenyl-alanine olefin amino acid connected by an all-carbon crosslinker comprising one double bond
  C-term NH2
LTFAEYWAQGASAA

SEQ ID NO: 160 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQFASAA

SEQ ID NO: 161 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQFASAA

SEQ ID NO: 162 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAA

SEQ ID NO: 163 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAA

SEQ ID NO: 164 - protein, 14 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 165 - protein, 14 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 166 - protein, 14 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 167 - protein, 14 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 168 - protein, 14 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 169 - protein, 14 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 170 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAEYWAQLASAA

SEQ ID NO: 171 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWVQLASAA

SEQ ID NO: 172 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAHWAQLASAA

SEQ ID NO: 173 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAEWAQLASAA

SEQ ID NO: 174 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAASWAQLASAA

SEQ ID NO: 175 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAEWAQLASAA

SEQ ID NO: 176 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAASWAQLASAA

SEQ ID NO: 177 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (11)..(11): Alpha-Me S5-pentenyl-alanine olefin amino acid connected by an all-carbon crosslinker comprising one double bond
  C-term NH2
LTFAAFWAQLASAA

SEQ ID NO: 178 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (11)..(11): Alpha-Me S5-pentenyl-alanine olefin amino acid connected by an all-carbon crosslinker comprising one double bond
  C-term NH2
LTFAAFWAQLASAA

SEQ ID NO: 179 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAHWAQLAAAIA

SEQ ID NO: 180 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
ITFAFYWAQLAAAIA

SEQ ID NO: 181 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
ITFAEHWAQLAAAIA

SEQ ID NO: 182 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
ITFAEHWAQLAAAIA

SEQ ID NO: 183 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
ETFAEHWAQLAAAIA

SEQ ID NO: 184 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
ETFAEHWAQLAAAIA

SEQ ID NO: 185 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAHWVQLAAAIA

SEQ ID NO: 186 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
ITFAFYWVQLAAAIA

SEQ ID NO: 187 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
ITFAEYWVQLAAAIA

SEQ ID NO: 188 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
ITFAEHWVQLAAAIA

SEQ ID NO: 189 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAEWAQLAAAIA

SEQ ID NO: 190 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAFWAQLAAAIA

SEQ ID NO: 191 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAFWAQLAAAIA

SEQ ID NO: 192 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAHWAQLAAHFA

SEQ ID NO: 193 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAFYWAQLAAHFA

SEQ ID NO: 194 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAFYWAQLAAHFA

SEQ ID NO: 195 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAFHWAQLAAEFA

SEQ ID NO: 196 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAFHWAQLAAEFA

SEQ ID NO: 197 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAEHWAQLAAHFA

SEQ ID NO: 198 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAEHWAQLAAHFA

SEQ ID NO: 199 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAHWVQLAAHFA

SEQ ID NO: 200 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAFYWVQLAAHFA

SEQ ID NO: 201 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAEYWVQLAAHFA

SEQ ID NO: 202 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAEHWVQLAAHFA

SEQ ID NO: 203 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAEHWVQLAAHFA

SEQ ID NO: 204 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAEYWAALASAA

SEQ ID NO: 205 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWVALASAA

SEQ ID NO: 206 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAHWAALASAA

SEQ ID NO: 207 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAEWAALASAA

SEQ ID NO: 208 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAEWAALASAA

SEQ ID NO: 209 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAASWAALASAA

SEQ ID NO: 210 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAASWAALASAA

SEQ ID NO: 211 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAALAAAIA

SEQ ID NO: 212 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAALAAAIA

SEQ ID NO: 213 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAALAAHFA

SEQ ID NO: 214 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEHWAQLAAHIA

SEQ ID NO: 215 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEHWAQLAAHIA

SEQ ID NO: 216 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAHWAQLAAHIA

SEQ ID NO: 217 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQLAAHIA

SEQ ID NO: 218 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAFA

SEQ ID NO: 219 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAFA

SEQ ID NO: 220 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAWA

SEQ ID NO: 221 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAVA

SEQ ID NO: 222 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAVA

SEQ ID NO: 223 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAALA

SEQ ID NO: 224 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAALA

SEQ ID NO: 225 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQLAAAIA

SEQ ID NO: 226 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQLAAAIA

SEQ ID NO: 227 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQLAAAFA

SEQ ID NO: 228 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQLAAAFA

SEQ ID NO: 229 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQLAAAVA

SEQ ID NO: 230 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQLAAAVA

SEQ ID NO: 231 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEHWAQLAAAIA

SEQ ID NO: 232 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEHWAQLAAAIA

SEQ ID NO: 233 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEHWAQLAAAWA

SEQ ID NO: 234 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEHWAQLAAAWA

SEQ ID NO: 235 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEHWAQLAAALA

SEQ ID NO: 236 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEHWAQLAAALA

SEQ ID NO: 237 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
ETFAEHWVQLAAALA

SEQ ID NO: 238 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAAA

SEQ ID NO: 239 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAAA

SEQ ID NO: 240 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): 2-aminoisobutyric acid
  C-term NH2
LTFAAYWAQLAAAXA

SEQ ID NO: 241 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): 2-aminoisobutyric acid
  C-term NH2
LTFAAYWAQLAAAXA

SEQ ID NO: 242 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (16)..(16): D-amino acid
  C-term NH2
LTFAAYWAQLAAAAAA

SEQ ID NO: 243 - protein, 15 aa, Artificial Sequence
  Description of Artificial Sequence: Synthetic peptide
  N-term Ac
  MOD_RES (4)..(4): Alpha-Me R5-pentenyl-alanine olefin amino acid connected by an all-carbon crosslinker comprising one double bond
  misc_feature (4)..(11): Crosslink between residues
  MOD_RES (11)..(11): Alpha-Me S8-octenyl-alanine olefin amino acid connected by an all-carbon crosslinker comprising one double bond
  MOD_RES (15)..(15): D-amino acid
  C-term NH2
LTFAAYWAQLAAAIA

SEQ ID NO: 244 - protein, 14 aa, Artificial Sequence
  Description of Artificial Sequence: Synthetic peptide
  N-term Ac
  MOD_RES (4)..(4): Alpha-Me R5-pentenyl-alanine olefin amino acid connected by an all-carbon crosslinker comprising one double bond
  misc_feature (4)..(11): Crosslink between residues
  MOD_RES (11)..(11): Alpha-Me S8-octenyl-alanine olefin amino acid connected by an all-carbon crosslinker comprising one double bond
  C-term NH2
LTFAAYWAQLASAA

SEQ ID NO: 245 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQAAAALA

SEQ ID NO: 246 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
ETFAAYWAQAAAALA

SEQ ID NO: 247 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEYWAQAAAALA

SEQ ID NO: 248 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQAAAWLA

SEQ ID NO: 249 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
ETFAAYWAQAAAWLA

SEQ ID NO: 250 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEYWAQAAAWLA

SEQ ID NO: 251 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAFA

SEQ ID NO: 252 - protein, 15 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEYWAQAASALA

SEQ ID NO: 253 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEFWAQAASALA

SEQ ID NO: 254 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEYWSQAASALA

SEQ ID NO: 255 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEYWWQAASALA

SEQ ID NO: 256 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQAAAAIA

SEQ ID NO: 257 - protein, 15 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQAAAAIA

SEQ ID NO: 258 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEFWAQAAAAIA

SEQ ID NO: 259 - protein, 14 aa, Artificial Sequence
  Description of Artificial Sequence: Synthetic peptide
  N-term Pam
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
ETFAEYWAQAASAA

SEQ ID NO: 260 - protein, 14 aa, Artificial Sequence
  Description of Artificial Sequence: Synthetic peptide
  N-term Ac
  MOD_RES (3)..(3): homo-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEFWAQAASAA

SEQ ID NO: 261 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTAAEYWAQAASAA

SEQ ID NO: 262 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYAAQAASAA

SEQ ID NO: 263 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 2-Naphthalanine
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYAAQAASAA

SEQ ID NO: 264 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAYWAQAASAA

SEQ ID NO: 265 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAF

SEQ ID NO: 266 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQAASAFA

SEQ ID NO: 267 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAYWAQAASAF

SEQ ID NO: 268 - protein, 14 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAYWAQAASAF

SEQ ID NO: 269 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAFWAQAASAF

SEQ ID NO: 270 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAF

SEQ ID NO: 271 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAYWSQAASAF

SEQ ID NO: 272 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAYWWQAASAF

SEQ ID NO: 273 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQAAAAIA

SEQ ID NO: 274 - protein, 15 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQAAAAIA

SEQ ID NO: 275 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQAAAAIA

SEQ ID NO: 276 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAFWAQAAAAIA

SEQ ID NO: 277 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQAAAAFA

SEQ ID NO: 278 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQAAAAFA

SEQ ID NO: 279 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
ETFAAYWAQAAAWLA

SEQ ID NO: 280 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
LTFAEYWAQAAAWLA

SEQ ID NO: 281 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
ETFAEYWAQAAAWLA

SEQ ID NO: 282 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
ETFAEYWAQAAAWLA

SEQ ID NO: 283 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQAASAFA

SEQ ID NO: 284 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQAASAFA

SEQ ID NO: 285 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
ETFAAYWAQLAAWLA

SEQ ID NO: 286 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
LTFAEYWAQLAAWLA

SEQ ID NO: 287 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
ETFAEYWAQLAAWLA

SEQ ID NO: 288 - protein, 14 aa, Artificial Sequence
  Description of Artificial Sequence: Synthetic peptide
  N-term Dmaac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 289 - protein, 14 aa, Artificial Sequence
  Description of Artificial Sequence: Synthetic peptide
  N-term Hexac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 290 - protein, 14 aa, Artificial Sequence
  Description of Artificial Sequence: Synthetic peptide
  N-term Napac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 291 - protein, 14 aa, Artificial Sequence
  Description of Artificial Sequence: Synthetic peptide
  N-term Decac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 292 - protein, 14 aa, Artificial Sequence
  Description of Artificial Sequence: Synthetic peptide
  N-term Admac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 293 - protein, 14 aa, Artificial Sequence
  Description of Artificial Sequence: Synthetic peptide
  N-term Tmac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 294 - protein, 14 aa, Artificial Sequence
  Description of Artificial Sequence: Synthetic peptide
  N-term Pam
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 295 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQAAAALA

SEQ ID NO: 296 - protein, 15 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQAAAAIA

SEQ ID NO: 297 - protein, 14 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAA

SEQ ID NO: 298 - protein, 14 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAA

SEQ ID NO: 299 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEFWAQAASAA

SEQ ID NO: 300 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEFWAQAASAA

SEQ ID NO: 301 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWSQAASAA

SEQ ID NO: 302 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWSQAASAA

SEQ ID NO: 303 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 304 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWAQLASAF

SEQ ID NO: 305 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWAQLASAF

SEQ ID NO: 306 - protein, 14 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWAQLASAA

SEQ ID NO: 307 - protein, 14 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWAQLASAA

SEQ ID NO: 308 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAFWAQLASAA

SEQ ID NO: 309 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAFWAQLASAA

SEQ ID NO: 310 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWSQLASAA

SEQ ID NO: 311 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWSQLASAA

SEQ ID NO: 312 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEYWAQLAAALA

SEQ ID NO: 313 - protein, 15 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 314 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAFWAQLAAALA

SEQ ID NO: 315 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWSQLAAALA

SEQ ID NO: 316 - protein, 15 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 317 - protein, 15 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 318 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): hLeu
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAFWAQLAAALA

SEQ ID NO: 319 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): hLeu
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAFWAQLAAALA

SEQ ID NO: 320 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWSQLAAALA

SEQ ID NO: 321 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWSQLAAALA

SEQ ID NO: 322 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  MOD_RES (16)..(16): D-amino acid
  C-term NH2
LTFAAYWAQLAAAAAA

SEQ ID NO: 323 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  MOD_RES (16)..(16): D-amino acid
  C-term NH2
LTFAAYWAQLAAAAAA

SEQ ID NO: 324 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYWAQLAAAAAAA

SEQ ID NO: 325 - protein, 18 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (18)..(18): D-amino acid
  C-term NH2
LTFAAYWAQLAAAAAAAA

SEQ ID NO: 326 - protein, 18 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (18)..(18): D-amino acid
  C-term NH2
LTFAAYWAQLAAAAAAAA

SEQ ID NO: 327 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEYWAQLAAALA

SEQ ID NO: 328 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): Norleucine
  C-term NH2
AATFAAYWAQLAAALA

SEQ ID NO: 329 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALAA

SEQ ID NO: 330 - protein, 17 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): Norleucine
  C-term NH2
ALTFAAYWAQLAAALAA

SEQ ID NO: 331 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQAAAALAA

SEQ ID NO: 332 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALAA

SEQ ID NO: 333 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAAA

SEQ ID NO: 334 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAAA

SEQ ID NO: 335 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAAAA

SEQ ID NO: 336 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAAAA

SEQ ID NO: 337 - protein, 15 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTFAEYWAQAASAA

SEQ ID NO: 338 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTFAEYWAQAASAAA

SEQ ID NO: 339 - protein, 15 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTFAEYWAQAASAA

SEQ ID NO: 340 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 341 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAA

SEQ ID NO: 342 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (7)..(7): 6cl-Trp
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEFWAQAASALA

SEQ ID NO: 343 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (7)..(7): 6cl-Trp
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEFWAQAASALA

SEQ ID NO: 344 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (7)..(7): 6cl-Trp
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEFWAQAAAAIA

SEQ ID NO: 345 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (7)..(7): 6cl-Trp
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEFWAQAAAAIA

SEQ ID NO: 346 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYWAQLAAAAAAA

SEQ ID NO: 347 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYWAQLAAAAAAA

SEQ ID NO: 348 - protein, 16 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(4): Crosslink between residues
  MOD_RES (5)..(5): 6cl-Trp
  MOD_RES (16)..(16): D-amino acid
  C-term NH2
FAAYWEALAAAAAAAA

SEQ ID NO: 349 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
ETFAEYWAQLAAAAAAA

SEQ ID NO: 350 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
ETFAEYWAQLAAAAAAA

SEQ ID NO: 351 - protein, 18 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (18)..(18): D-amino acid
  C-term NH2
LTFAEYWAQLAAAAAAAA

SEQ ID NO: 352 - protein, 18 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (18)..(18): D-amino acid
  C-term NH2
LTFAEYWAQLAAAAAAAA

SEQ ID NO: 353 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (17)..(17): D-amino acid
  C-term NH2
LTFAAYWAQLAAALAAA

SEQ ID NO: 354 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (17)..(17): D-amino acid
  C-term NH2
LTFAAYWAQLAAALAAA

SEQ ID NO: 355 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQAAAAAAAA

SEQ ID NO: 356 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQAAAAAAAA

SEQ ID NO: 357 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEFWAQAAAAAAAA

SEQ ID NO: 358 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEFWAQAAAAAAAA

SEQ ID NO: 359 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWSQAAAAAAAA

SEQ ID NO: 360 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWSQAAAAAAAA

SEQ ID NO: 361 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQAASAAA

SEQ ID NO: 362 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQAASAAA

SEQ ID NO: 363 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  MOD_RES (16)..(16): D-amino acid
  C-term NH2
ALTFAEYWAQAASAAA

SEQ ID NO: 364 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  MOD_RES (16)..(16): D-amino acid
  C-term NH2
ALTFAEYWAQAASAAA

SEQ ID NO: 365 - protein, 17 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  MOD_RES (17)..(17): D-amino acid
  C-term NH2
ALTFAEYWAQAASAAAA

SEQ ID NO: 366 - protein, 17 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  MOD_RES (17)..(17): D-amino acid
  C-term NH2
ALTFAEYWAQAASAAAA

SEQ ID NO: 367 - protein, 18 aa, Artificial Sequence
  Description of Artificial Sequence: Synthetic peptide
  N-term Ac
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (12)..(12): Cyclobutyl-Ala
  MOD_RES (13)..(13): Alpha-Me S5-pentenyl-alanine olefin amino acid connected by an all-carbon crosslinker comprising one double bond
  MOD_RES (18)..(18): D-amino acid
  C-term NH2
AALTFAEYWAQAASAAAA

SEQ ID NO: 368 - protein, 18 aa, Artificial Sequence
  Description of Artificial Sequence: Synthetic peptide
  N-term Ac
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (12)..(12): Cyclobutyl-Ala
  MOD_RES (13)..(13): Alpha-Me S5-pentenyl-alanine olefin amino acid connected by an all-carbon crosslinker comprising one double bond
  MOD_RES (18)..(18): D-amino acid
  C-term NH2
AALTFAEYWAQAASAAAA

SEQ ID NO: 369 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
RTFAEYWAQAASAA

SEQ ID NO: 370 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LRFAEYWAQAASAA

SEQ ID NO: 371 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWRQAASAA

SEQ ID NO: 372 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWARAASAA

SEQ ID NO: 373 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAARAA

SEQ ID NO: 374 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASRA

SEQ ID NO: 375 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAR

SEQ ID NO: 376 - protein, 15 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTFAEYWAQAASAA

SEQ ID NO: 377 - protein, 16 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): Norleucine
  C-term NH2
ALTFAAYWAQLAAALA

SEQ ID NO: 378 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LAFAEYWAQLAAALA

SEQ ID NO: 379 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
ATFAEYWAQLAAALA

SEQ ID NO: 380 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
AAFAEYWAQLAAALA

SEQ ID NO: 381 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): Norleucine
  C-term NH2
AAAFAEYWAQLAAALA

SEQ ID NO: 382 - protein, 17 aa, Artificial Sequence
  Description of Artificial Sequence: Synthetic peptide
  N-term Ac
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): Norleucine
  C-term NH2
AAAAFAEYWAQLAAALA

SEQ ID NO: 383 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): Norleucine
  C-term NH2
AATFAEYWAQLAAALA

SEQ ID NO: 384 - protein, 17 aa, Artificial Sequence
  Description of Artificial Sequence: Synthetic peptide
  N-term Ac
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): Norleucine
  C-term NH2
AALTFAEYWAQLAAALA

SEQ ID NO: 385 - protein, 18 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  MOD_RES (17)..(17): Norleucine
  C-term NH2
AAALTFAEYWAQLAAALA

SEQ ID NO: 386 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEYWAQLAAALAA

SEQ ID NO: 387 - protein, 17 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): Norleucine
  C-term NH2
ALTFAEYWAQLAAALAA

SEQ ID NO: 388 - protein, 18 aa, Artificial Sequence
  Description of Artificial Sequence: Synthetic peptide
  N-term Ac
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): Norleucine
  C-term NH2
AALTFAEYWAQLAAALAA

SEQ ID NO: 389 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEYWAQAAAALAA

SEQ ID NO: 390 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEYWAQLAAALAA

SEQ ID NO: 391 - protein, 17 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): hLeu
  MOD_RES (12)..(12): Alpha-Me S5-pentenyl-alanine olefin amino acid connected by an all-carbon crosslinker comprising one double bond
  MOD_RES (15)..(15): Norleucine
  C-term NH2
ALTFAEYWAQLAAALAA

SEQ ID NO: 392 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): N-methyl-Tyr
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 393 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): N-methyl-Tyr
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 394 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): N-methyl-Trp
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 395 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): N-methyl-Trp
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 396 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): Alpha-Me-Trp
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 397 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): Alpha-Me-Trp
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 398 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): 2-aminoisobutyric acid
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWXQLAAALA

SEQ ID NO: 399 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): 2-aminoisobutyric acid
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWXQLAAALA

SEQ ID NO: 400 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): 2-aminoisobutyric acid
  MOD_RES (14)..(14): Norleucine
  C-term NH2
LTFAAYWAQLAAXLA

SEQ ID NO: 401 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): 2-aminoisobutyric acid
  MOD_RES (14)..(14): Norleucine
  C-term NH2
LTFAAYWAQLAAXLA

SEQ ID NO: 402 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): D-amino acid
  MOD_RES (14)..(14): Norleucine
  C-term NH2
LTFAAYWAQLAAALA

SEQ ID NO: 403 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): D-amino acid
  MOD_RES (14)..(14): Norleucine
  C-term NH2
LTFAAYWAQLAAALA

SEQ ID NO: 404 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): Sarcosine
  MOD_RES (14)..(14): Norleucine
  C-term NH2
LTFAAYWAQLAAXLA

SEQ ID NO: 405 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): Sarcosine
  MOD_RES (14)..(14): Norleucine
  C-term NH2
LTFAAYWAQLAAXLA

SEQ ID NO: 406 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): 2-aminoisobutyric acid
  C-term NH2
LTFAAYWAQLAAALX

SEQ ID NO: 407 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): 2-aminoisobutyric acid
  C-term NH2
LTFAAYWAQLAAALX

SEQ ID NO: 408 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): N-methyl-Ala
  C-term NH2
LTFAAYWAQLAAALA

SEQ ID NO: 409 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): N-methyl-Ala
  C-term NH2
LTFAAYWAQLAAALA

SEQ ID NO: 410 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): Sarcosine
  C-term NH2
LTFAAYWAQLAAALX

SEQ ID NO: 411 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): Sarcosine
  C-term NH2
LTFAAYWAQLAAALX

SEQ ID NO: 412 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (16)..(16): 2-aminoisobutyric acid
  C-term NH2
LTFAAYWAQLAAALAX

SEQ ID NO: 413 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (16)..(16): 2-aminoisobutyric acid
  C-term NH2
LTFAAYWAQLAAALAX

SEQ ID NO: 414 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (16)..(16): N-methyl-Ala
  C-term NH2
LTFAAYWAQLAAALAA

SEQ ID NO: 415 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (16)..(16): N-methyl-Ala
  C-term NH2
LTFAAYWAQLAAALAA

SEQ ID NO: 416 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (16)..(16): D-amino acid
  C-term NH2
LTFAAYWAQLAAALAA

SEQ ID NO: 417 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (16)..(16): D-amino acid
  C-term NH2
LTFAAYWAQLAAALAA

SEQ ID NO: 418 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (16)..(16): Sarcosine
  C-term NH2
LTFAAYWAQLAAALAX

SEQ ID NO: 419 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (16)..(16): Sarcosine
  C-term NH2
LTFAAYWAQLAAALAX

SEQ ID NO: 420 - protein, 15 aa, Artificial Sequence
  Description of Artificial Sequence: Synthetic peptide
  N-term Ac
  MOD_RES (4)..(4): Alpha-Me R8-octenyl-alanine olefin amino acid that is not connected by a crosslinker
  MOD_RES (11)..(11): Alpha-Me S5-pentenyl-alanine olefin amino acid that is not connected by a crosslinker
  MOD_RES (14)..(14): Norleucine
  C-term NH2
LTFAAYWAQLAAALA

SEQ ID NO: 421 - protein, 15 aa, Artificial Sequence
  Description of Artificial Sequence: Synthetic peptide
  N-term Ac
  MOD_RES (4)..(4): 2-aminoisobutyric acid
  MOD_RES (11)..(11): 2-aminoisobutyric acid
  MOD_RES (14)..(14): Norleucine
  C-term NH2
LTFXAYWAQLXAALA

SEQ ID NO: 422 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): Cou4
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAXYWAQLAAALA

SEQ ID NO: 423 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): Cou4
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAXYWAQLAAALA

SEQ ID NO: 424 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou4
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWXQLAAALA

SEQ ID NO: 425 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (12)..(12): Cou4
  MOD_RES (14)..(14): Norleucine
  C-term NH2
LTFAAYWAQLAXALA

SEQ ID NO: 426 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (12)..(12): Cou4
  MOD_RES (14)..(14): Norleucine
  C-term NH2
LTFAAYWAQLAXALA

SEQ ID NO: 427 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): Cou4
  MOD_RES (14)..(14): Norleucine
  C-term NH2
LTFAAYWAQLAAXLA

SEQ ID NO: 428 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): Cou4
  MOD_RES (14)..(14): Norleucine
  C-term NH2
LTFAAYWAQLAAXLA

SEQ ID NO: 429 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term OH
LTFAAYWAQLAAALA

SEQ ID NO: 430 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term OH
LTFAAYWAQLAAALA

SEQ ID NO: 431 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NHnPr
LTFAAYWAQLAAALA

SEQ ID NO: 432 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NHnPr
LTFAAYWAQLAAALA

SEQ ID NO: 433 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NHnBu33Me
LTFAAYWAQLAAALA

SEQ ID NO: 434 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NHnBu33Me
LTFAAYWAQLAAALA

SEQ ID NO: 435 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NHHex
LTFAAYWAQLAAALA

SEQ ID NO: 436 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NHHex
LTFAAYWAQLAAALA

SEQ ID NO: 437 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTAAAYWAQLAAALA

SEQ ID NO: 438 - protein, 15 aa, Artificial Sequence
  Description of Artificial Sequence: Synthetic peptide
  N-term Ac
  MOD_RES (3)..(3): hLeu
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTLAAYWAQLAAALA

SEQ ID NO: 439 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYAAQLAAALA

SEQ ID NO: 440 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 2-Naphthalanine
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYAAQLAAALA

SEQ ID NO: 441 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou4
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWXQAASAA

SEQ ID NO: 442 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWXQAASAA

SEQ ID NO: 443 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon saturated crosslinker comprising no double bonds
  C-term NH2
LTFAEYWAQAASAA

SEQ ID NO: 444 - protein, 14 aa, Artificial Sequence
  Description of Artificial Sequence: Synthetic peptide
  N-term Dmaac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAA

SEQ ID NO: 445 - protein, 17 aa, Artificial Sequence
  Description of Artificial Sequence: Synthetic peptide
  N-term Dmaac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYWAQLAAAAAAA

SEQ ID NO: 446 - protein, 17 aa, Artificial Sequence
  Description of Artificial Sequence: Synthetic peptide
  N-term Dmaac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYWAQLAAAAAAA

SEQ ID NO: 447 - protein, 17 aa, Artificial Sequence
  Description of Artificial Sequence: Synthetic peptide
  N-term Dmaac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 448 - protein, 17 aa, Artificial Sequence
  Description of Artificial Sequence: Synthetic peptide
  N-term Dmaac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 449 - protein, 15 aa, Artificial Sequence
  Description of Artificial Sequence: Synthetic peptide
  N-term Dmaac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEFWAQAAAAIA

SEQ ID NO: 450 - protein, 15 aa, Artificial Sequence
  Description of Artificial Sequence: Synthetic peptide
  N-term Dmaac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEFWAQAAAAIA

SEQ ID NO: 451 - protein, 15 aa, Artificial Sequence
  Description of Artificial Sequence: Synthetic peptide
  N-term Dmaac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 452 - protein, 15 aa, Artificial Sequence
  Description of Artificial Sequence: Synthetic peptide
  N-term Dmaac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 453 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (11)..(11): Alpha-Me S5-pentenyl-alanine olefin amino acid connected by an all-carbon crosslinker comprising no double bonds
  MOD_RES (14)..(14): Norleucine
  C-term NH2
LTFAAYWAQLAAALA

SEQ ID NO: 454 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (11)..(11): Alpha-Me S5-pentenyl-alanine olefin amino acid connected by an all-carbon crosslinker comprising no double bonds
  MOD_RES (17)..(17): D-amino acid
  C-term NH2
LTFAEYWAQLAAAAAAA

SEQ ID NO: 455 - protein, 16 aa, Artificial Sequence
  Description of Artificial Sequence: Synthetic peptide
  MOD_RES (1)..(1): Cou6
  MOD_RES (2)..(2): Beta-Ala
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (12)..(12): hLeu
  MOD_RES (13)..(13): Alpha-Me S5-pentenyl-alanine olefin amino acid connected by an all-carbon crosslinker comprising one double bond
  C-term NH2
XALTFAEYWAQLASAA

SEQ ID NO: 456 - protein, 16 aa, Artificial Sequence
  Description of Artificial Sequence: Synthetic peptide
  MOD_RES (1)..(1): Cou8
  MOD_RES (2)..(2): Beta-Ala
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (12)..(12): hLeu
  MOD_RES (13)..(13): Alpha-Me S5-pentenyl-alanine olefin amino acid connected by an all-carbon crosslinker comprising one double bond
  C-term NH2
XALTFAEYWAQLASAA

SEQ ID NO: 457 - protein, 17 aa, Artificial Sequence
  Description of Artificial Sequence: Synthetic peptide
  N-term Ac
  MOD_RES (3)..(3): 4-iodo-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 458 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 459 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term OH
LTFAEYWAQLAAAAAAA

SEQ ID NO: 460 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term OH
LTFAEYWAQLAAAAAAA

SEQ ID NO: 461 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAELAAAAAAA

SEQ ID NO: 462 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAELAAAAAAA

SEQ ID NO: 463 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term OH
LTFAEYWAELAAAAAAA

SEQ ID NO: 464 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 465 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Phe-4bOH2
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEFWAQLAAAAAAA

SEQ ID NO: 466 - protein, 20 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  MOD_RES (20)..(20): D-amino acid
  C-term NH2
AAALTFAEYWAQLAAAAAAA

SEQ ID NO: 467 - protein, 17 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 468 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
RTFAEYWAQLAAAAAAA

SEQ ID NO: 469 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTAAEYWAQLAAAAAAA

SEQ ID NO: 470 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): 2-aminoisobutyric acid
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWXQLAAAAAAA

SEQ ID NO: 471 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): 2-aminoisobutyric acid
  MOD_RES (17)..(17): D-amino acid
  C-term NH2
LTFAEYWAQLAAXAAAA

SEQ ID NO: 472 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): 2-aminoisobutyric acid
  MOD_RES (17)..(17): D-amino acid
  C-term NH2
LTFAEYWAQLAAAXAAA

SEQ ID NO: 473 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): 2-aminoisobutyric acid
  MOD_RES (17)..(17): D-amino acid
  C-term NH2
LTFAEYWAQLAAAAXAA

SEQ ID NO: 474 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (16)..(16): 2-aminoisobutyric acid
  MOD_RES (17)..(17): D-amino acid
  C-term NH2
LTFAEYWAQLAAAAAXA

SEQ ID NO: 475 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (16)..(16): 2-aminoisobutyric acid
  MOD_RES (17)..(17): D-amino acid
  C-term NH2
LTFAEYWAQLAAAAAXA

SEQ ID NO: 476 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): 2-aminoisobutyric acid
  C-term NH2
LTFAEYWAQLAAAAAAX

SEQ ID NO: 477 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): D-amino acid
  MOD_RES (17)..(17): D-amino acid
  C-term NH2
LTFAEYWAQLAAAAAAA

SEQ ID NO: 478 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): D-amino acid
  MOD_RES (17)..(17): D-amino acid
  C-term NH2
LTFAEYWAQLAAAAAAA

SEQ ID NO: 479 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  MOD_RES (17)..(17): D-amino acid
  C-term NH2
LTFAEYWAQLAAAAAAA

SEQ ID NO: 480 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  MOD_RES (17)..(17): D-amino acid
  C-term NH2
LTFAEYWAQLAAAAAAA

SEQ ID NO: 481 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (16)..(17): D-amino acid
  C-term NH2
LTFAEYWAQLAAAAAAA

SEQ ID NO: 482 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLAAAAAAA

SEQ ID NO: 483 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): Sarcosine
  MOD_RES (17)..(17): D-amino acid
  C-term NH2
LTFAEYWAQLAAXAAAA

SEQ ID NO: 484 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Sarcosine
  MOD_RES (17)..(17): D-amino acid
  C-term NH2
LTFAEYWAQLAAAXAAA

SEQ ID NO: 485 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): Sarcosine
  MOD_RES (17)..(17): D-amino acid
  C-term NH2
LTFAEYWAQLAAAAXAA

SEQ ID NO: 486 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (16)..(16): Sarcosine
  MOD_RES (17)..(17): D-amino acid
  C-term NH2
LTFAEYWAQLAAAAAXA

SEQ ID NO: 487 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): Sarcosine
  C-term NH2
LTFAEYWAQLAAAAAAX

SEQ ID NO: 488 - protein, 17 aa, Artificial Sequence
  Description of Artificial Sequence: Synthetic peptide
  N-term Ac
  MOD_RES (1)..(1): N15 isotopic-Leu
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 489 - protein, 16 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  MOD_RES (16)..(16): D-amino acid
  C-term NH2
TFAEYWAQLAAAAAAA

SEQ ID NO: 490 - protein, 15 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (15)..(15): D-amino acid
  C-term NH2
FAEYWAQLAAAAAAA

SEQ ID NO: 491 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LVFAEYWAQLAAAAAAA

SEQ ID NO: 492 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
AAFAEYWAQLAAAAAAA

SEQ ID NO: 493 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (16)..(16): D-amino acid
  C-term NH2
LTFAEYWAQLAAAAAA

SEQ ID NO: 494 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQLAAAAA

SEQ ID NO: 495 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): D-amino acid
  C-term NH2
LTFAEYWAQLAAAA

SEQ ID NO: 496 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): D-amino acid
  C-term NH2
LTFAEYWAQLAAA

SEQ ID NO: 497 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (12)..(12): D-amino acid
  C-term NH2
LTFAEYWAQLAA

SEQ ID NO: 498 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term OH
LTFAEYWAQLAAAA

SEQ ID NO: 499 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term OH
LTFAEYWAQLAA

SEQ ID NO: 500 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLAAAA

SEQ ID NO: 501 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term OH
LTFAEYWAQAASAA

SEQ ID NO: 502 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term OH
LTFAEYWAQAAS

SEQ ID NO: 503 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAAS

SEQ ID NO: 504 - protein, 17 aa, Artificial Sequence
  Description of Artificial Sequence: Synthetic peptide
  N-term 4FBzl
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 505 - protein, 14 aa, Artificial Sequence
  Description of Artificial Sequence: Synthetic peptide
  N-term 4FBzl
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAA

SEQ ID NO: 506 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFARYWAQLAAAAAAA

SEQ ID NO: 507 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAHYWAQLAAAAAAA

SEQ ID NO: 508 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAQYWAQLAAAAAAA

SEQ ID NO: 509 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): Cit
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAXYWAQLAAAAAAA

SEQ ID NO: 510 - protein, 19 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(13): Crosslink between residues
  MOD_RES (6)..(7): D-amino acid
  MOD_RES (13)..(13): Alpha-Me S5-pentenyl-alanine olefin amino acid connected by an all-carbon crosslinker comprising one double bond
  MOD_RES (19)..(19): D-amino acid
  C-term NH2
LTFAELAYWAQLAAAAAAA

SEQ ID NO: 511 - protein, 18 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(12): Crosslink between residues
  MOD_RES (5)..(5): Phe-4
  MOD_RES (6)..(6): D-amino acid
  MOD_RES (12)..(121): Alpha-Me S5-pentenyl-alanine olefin amino acid connected by an all-carbon crosslinker comprising one double bond
  MOD_RES (18)..(18): D-amino acid
  C-term NH2
LTFAFGYWAQLAAAAAAA

SEQ ID NO: 512 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): 2m-Arg
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFARYWAQLAAAAAAA

SEQ ID NO: 513 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): ip-Lys
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAKYWAQLAAAAAAA

SEQ ID NO: 514 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): Phe-4NH2
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAFYWAQLAAAAAAA

SEQ ID NO: 515 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAALAAAAAAA

SEQ ID NO: 516 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWALLAAAAAAA

SEQ ID NO: 517 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): 2-aminoisobutyric acid
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAXLAAAAAAA

SEQ ID NO: 518 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWASLAAAAAAA

SEQ ID NO: 519 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWANLAAAAAAA

SEQ ID NO: 520 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Cit
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAXLAAAAAAA

SEQ ID NO: 521 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAHLAAAAAAA

SEQ ID NO: 522 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWARLAAAAAAA

SEQ ID NO: 523 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  MOD_RES (6)..(6): pTyr
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 524 - protein, 14 aa, Artificial Sequence
  Description of Artificial Sequence: Synthetic peptide
  N-term Cbm
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAA

SEQ ID NO: 525 - protein, 17 aa, Artificial Sequence
  Description of Artificial Sequence: Synthetic peptide
  N-term Cbm
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 526 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLASAAAAA

SEQ ID NO: 527 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAASA

SEQ ID NO: 528 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLASAAASA

SEQ ID NO: 529 - protein, 18 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(12): Crosslink between residues
  MOD_RES (11)..(11): Beta-Ala
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
LTFAEYWAQTAAAAAAAA

SEQ ID NO: 530 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Adamantyl-Gly
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQGAAAAAAA

SEQ ID NO: 531 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Ala
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQAAAAAAAA

SEQ ID NO: 532 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): homo-cyclohexyl-Ala
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQAAAAAAAA

SEQ ID NO: 533 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQFAAAAAAA

SEQ ID NO: 534 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): homo-Phe
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQFAAAAAAA

SEQ ID NO: 535 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (17)..(17): D-amino acid
  C-term NH2
LTFAEYWAQLAAALAAA

SEQ ID NO: 536 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Adamantyl-Gly
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (17)..(17): D-amino acid
  C-term NH2
LTFAEYWAQGAAALAAA

SEQ ID NO: 537 - protein, 18 aa, Artificial Sequence
  Description of Artificial Sequence: Synthetic peptide
  N-term 4FBz
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTFAEYWAQLAAAAAAA

SEQ ID NO: 538 - protein, 15 aa, Artificial Sequence
  Description of Artificial Sequence: Synthetic peptide
  N-term 4FBz
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTFAEYWAQAASAA

SEQ ID NO: 539 - protein, 17 aa, Artificial Sequence
  Description of Artificial Sequence: Synthetic peptide
  N-term Ac
  MOD_RES (4)..(4): Alpha-Me R5-pentenyl-alanine olefin amino acid connected by an all-carbon crosslinker comprising one double bond
  misc_feature (4)..(11): Crosslink between residues
  MOD_RES (11)..(11): Alpha-Me S8-octenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 540 - protein, 14 aa, Artificial Sequence
  Description of Artificial Sequence: Synthetic peptide
  N-term Ac
  MOD_RES (4)..(4): Alpha-Me R5-pentenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S8-octenyl-alanine olefin amino acid connected by an all-carbon crosslinker comprising one double bond
  C-term NH2
LTFAEYWAQAASAA

SEQ ID NO: 541 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): hhLeu
  MOD_RES (17)..(17): D-amino acid
  C-term NH2
LTFAEYWAQLAAALAAA

SEQ ID NO: 542 - protein, 19 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (19)..(19): D-amino acid
  C-term NH2
LTFAEYWAQLAAAAAAAAA

SEQ ID NO: 543 - protein, 20 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (20)..(20): D-amino acid
  C-term NH2
LTFAEYWAQLAAAAAAAAAA

SEQ ID NO: 544 - protein, 21 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (21)..(21): D-amino acid
  C-term NH2
LTFAEYWAQLAAAAAAAAAAA

SEQ ID NO: 545 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTAAEYAAQAASAA

SEQ ID NO: 546 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTAAEYAAQLAAAAAAA

SEQ ID NO: 547 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Pmp
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEXWAQLAAAAAAA

SEQ ID NO: 548 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Pmp
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEXWAQAASAA

SEQ ID NO: 549 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ATFAHYWAQLAS

SEQ ID NO: 550 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHAWAQLAS

SEQ ID NO: 551 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQAAS

SEQ ID NO: 552 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASA

SEQ ID NO: 553 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 554 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAHYWAQAASAA

SEQ ID NO: 555 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFASYWAQAASAA

SEQ ID NO: 556 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFARYWAQAASAA

SEQ ID NO: 557 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAKYWAQAASAA

SEQ ID NO: 558 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAQYWAQAASAA

SEQ ID NO: 559 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAAAASAA

SEQ ID NO: 560 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAAAAA

SEQ ID NO: 561 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term OH
LTFAEYWAQLAAAAAA

SEQ ID NO: 562 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term OH
LTFAEYWAQLAAAAA

SEQ ID NO: 563 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term OH
LTFAEYWAQLAAA

SEQ ID NO: 564 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Phe-4bOH2
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAFWAQLAAAAAAA

SEQ ID NO: 565 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Phe-4bOH2
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAFWAALAAAAAAA

SEQ ID NO: 566 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Phe-4bOH2
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEFWAQAASAA

SEQ ID NO: 567 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): pY
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYWAQLAAAAAAA

SEQ ID NO: 568 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): pY
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYWAALAAAAAAA

SEQ ID NO: 569 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): pY
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAA

SEQ ID NO: 570 - protein, 17 aa, Artificial Sequence
  Description of Artificial Sequence: Synthetic peptide
  N-term Ac
  MOD_RES (4)..(4): Alpha-Me R6-hexynyl-alanine alkynyl amino acids, crosslink via a dialkyne bond with a second alkynyl amino acid
  misc_feature (4)..(11): Crosslink between residues
  MOD_RES (11)..(11): Alpha-Me S5-pentynyl-alanine alkynyl amino acids, wherein the alkyne forms one half of a dialkyne bond with a second alkynyl amino acid
  MOD_RES (17)..(17): D-amino acid
  C-term NH2
LTFAAYWAQLAAAAAAA

SEQ ID NO: 571 - protein, 14 aa, Artificial Sequence
  Description of Artificial Sequence: Synthetic peptide
  N-term Ac
  MOD_RES (4)..(4): Alpha-Me R6-hexynyl-alanine alkynyl amino acids, crosslink via a dialkyne bond with a second alkynyl amino acid
  misc_feature (4)..(11): Crosslink between residues
  MOD_RES (10)..(10): Cyclobutyl-Ala
  MOD_RES (11)..(11): Alpha-Me S5-pentynyl-alanine alkynyl amino acids, wherein the alkyne forms one half of a dialkyne bond with a second alkynyl amino acid
  C-term NH2
LTFAEYWAQAASAA

SEQ ID NO: 572 - protein, 17 aa, Artificial Sequence
  Description of Artificial Sequence: Synthetic peptide
  N-term Ac
  MOD_RES (4)..(4): Alpha-Me R6-hexynyl-alanine alkynyl amino acids, crosslink via a dialkyne bond with a second alkynyl amino acid
  misc_feature (4)..(11): Crosslink between residues
  MOD_RES (11)..(11): Alpha-Me S5-pentynyl-alanine alkynyl amino acids, wherein the alkyne forms one half of a dialkyne bond with a second alkynyl amino acid
  MOD_RES (17)..(17): D-amino acid
  C-term NH2
LTFAEYWAQLAAAAAAA

SEQ ID NO: 573 - protein, 17 aa, Artificial Sequence
  Description of Artificial Sequence: Synthetic peptide
  N-term Ac
  MOD_RES (4)..(4): Alpha-Me R9-nonynyl-alanine alkynyl amino acid crosslinked via an alkyne metathesis reaction with a second alkynyl amino acid
  misc_feature (4)..(11): Crosslink between residues
  MOD_RES (11)..(11): Alpha-Me S6-hexynyl-alanine alkynyl amino acid crosslinked via an alkyne metathesis reaction with a second alkynyl amino acid
  MOD_RES (17)..(17): D-amino acid
  C-term NH2
LTFAEYWAQLAAAAAAA

SEQ ID NO: 574 - protein, 17 aa, Artificial Sequence
  Description of Artificial Sequence: Synthetic peptide
  N-term Ac
  MOD_RES (4)..(4): Alpha-Me R9-nonynyl-alanine alkynyl amino acid crosslinked via an alkyne metathesis reaction with a second alkynyl amino acid
  misc_feature (4)..(11): Crosslink between residues
  MOD_RES (11)..(11): Alpha-Me S6-hexynyl-alanine alkynyl amino acid crosslinked via an alkyne metathesis reaction with a second alkynyl amino acid
  MOD_RES (17)..(17): D-amino acid
  C-term NH2
LTFAEYWAQLAAAAAAA

SEQ ID NO: 575 - protein, 14 aa, Artificial Sequence
  Description of Artificial Sequence: Synthetic peptide
  N-term Ac
  MOD_RES (4)..(4): Alpha-Me R9-nonynyl-alanine alkynyl amino acid crosslinked via an alkyne metathesis reaction with a second alkynyl amino acid
  misc_feature (4)..(11): Crosslink between residues
  MOD_RES (10)..(10): Cyclobutyl-Ala
  MOD_RES (11)..(11): Alpha-Me S6-hexynyl-alanine alkynyl amino acid crosslinked via an alkyne metathesis reaction with a second alkynyl amino acid
  C-term NH2
LTFAEYWAQAASAA

SEQ ID NO: 576 - protein, 14 aa, Artificial Sequence
  Description of Artificial Sequence: Synthetic peptide
  N-term Ac
  MOD_RES (4)..(4): Alpha-Me R9-nonynyl-alanine alkynyl amino acid crosslinked via an alkyne metathesis reaction with a second alkynyl amino acid
  misc_feature (4)..(11): Crosslink between residues
  MOD_RES (10)..(10): Cyclobutyl-Ala
  MOD_RES (11)..(11): Alpha-Me S6-hexynyl-alanine alkynyl amino acid crosslinked via an alkyne metathesis reaction with a second alkynyl amino acid
  C-term NH2
LTAAEYWAQAASAA

SEQ ID NO: 577 - protein, 15 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R9-nonynyl-alanine alkynyl amino acid crosslinked via an alkyne metathesis reaction with a second alkynyl amino acid
  misc_feature (5)..(12): Crosslink between residues
  MOD_RES (11)..(11): Cyclobutyl-Ala
  MOD_RES (12)..(12): Alpha-Me S6-hexynyl-alanine alkynyl amino acid crosslinked via an alkyne metathesis reaction with a second alkynyl amino acid
  C-term NH2
ALTFAEYWAQAASAA

SEQ ID NO: 578 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTFAEYWAQLAAAAAAA

SEQ ID NO: 579 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid that is not connected by a crosslinker
  MOD_RES (12)..(12): Alpha-Me S5-pentenyl-alanine olefin amino acid that is not connected by a crosslinker
  MOD_RES (18)..(18): D-amino acid
  C-term NH2
ALTFAEYWAQLAAAAAAA

SEQ ID NO: 580 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTAAEYWAQLAAAAAAA

SEQ ID NO: 581 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTFAAYWAQLAAAAAAA

SEQ ID NO: 582 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
AATFAEYWAQLAAAAAAA

SEQ ID NO: 583 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALAFAEYWAQLAAAAAAA

SEQ ID NO: 584 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTFAEAWAQLAAAAAAA

SEQ ID NO: 585 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTFAEYAAQLAAAAAAA

SEQ ID NO: 586 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTAAEYAAQLAAAAAAA

SEQ ID NO: 587 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTFAEYWAALAAAAAAA

SEQ ID NO: 588 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTFAEYWAQAAAAAAAA

SEQ ID NO: 589 - protein, 15 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid that is not connected by a crosslinker
  MOD_RES (11)..(11): Cyclobutyl-Ala
  MOD_RES (12)..(12): Alpha-Me S5-pentenyl-alanine olefin amino acid that is not connected by a crosslinker
  C-term NH2
ALTFAEYWAQAASAA

SEQ ID NO: 590 - protein, 15 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTAAEYWAQAASAA

SEQ ID NO: 591 - protein, 15 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTFAEYAAQAASAA

SEQ ID NO: 592 - protein, 15 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTAAEYAAQAASAA

SEQ ID NO: 593 - protein, 17 aa, Artificial Sequence
  Description of Artificial Sequence: Synthetic peptide
  N-term 5-FAM
  MOD_RES (1)..(1): Beta-Ala
  MOD_RES (8)..(8): Alpha-Me R8-octenyl-alanine olefin amino acid connected by an all-carbon crosslinker comprising one double bond
  misc_feature (8)..(15): Crosslink between residues
  MOD_RES (15)..(15): Alpha-Me S5-pentenyl-alanine olefin amino acid connected by an all-carbon crosslinker comprising one double bond
  C-term NH2
AQSQQTFANLWRLLAQN

SEQ ID NO: 594 - protein, 15 aa, Artificial Sequence
  Description of Artificial Sequence: Synthetic peptide
  N-term 5-TAMRA
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTFAEYWAQAASAA

SEQ ID NO: 595 - protein, 15 aa, Artificial Sequence
  Description of Artificial Sequence: Synthetic peptide
  N-term 5-TAMRA
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTAAEYWAQAASAA

SEQ ID NO: 596 - protein, 15 aa, Artificial Sequence
  Description of Artificial Sequence: Synthetic peptide
  N-term 5-TAMRA
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTFAEYAAQAASAA

SEQ ID NO: 597 - protein, 15 aa, Artificial Sequence
  Description of Artificial Sequence: Synthetic peptide
  N-term 5-TAMRA
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTAAEYAAQAASAA

SEQ ID NO: 598 - protein, 15 aa, Artificial Sequence
  Description of Artificial Sequence: Synthetic peptide
  N-term 5-TAMRA
  MOD_RES (1)..(1): Beta-Ala
  MOD_RES (5)..(5): Alpha-Me R8-octenyl-alanine olefin amino acid that is not connected by a crosslinker
  MOD_RES (11)..(11): Cyclobutyl-Ala
  MOD_RES (12)..(12): Alpha-Me S5-pentenyl-alanine olefin amino acid that is not connected by a crosslinker
  C-term NH2
ALTFAEYWAQAASAA

SEQ ID NO: 599 - protein, 18 aa, Artificial Sequence
  Description of Artificial Sequence: Synthetic peptide
  N-term 5-TAMRA
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTFAEYWAQLAAAAAAA

SEQ ID NO: 600 - protein, 18 aa, Artificial Sequence
  Description of Artificial Sequence: Synthetic peptide
  N-term 5-TAMRA
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTAAEYWAQLAAAAAAA

SEQ ID NO: 601 - protein, 18 aa, Artificial Sequence
  Description of Artificial Sequence: Synthetic peptide
  N-term 5-TAMRA
  MOD_RES (1)..(1): Beta-Ala
  MOD_RES (5)..(5): Alpha-Me R8-octenyl-alanine olefin amino acid that is not connected by a crosslinker
  MOD_RES (12)..(12): Alpha-Me S5-pentenyl-alanine olefin amino acid that is not connected by a crosslinker
  MOD_RES (18)..(18): D-amino acid
  C-term NH2
ALTFAEYWAQLAAAAAAA

SEQ ID NO: 602 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term OH
LTFAEYWXQAASAA

SEQ ID NO: 603 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term OH
LTFAEYWXQAAS

SEQ ID NO: 604 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTAAEYWXQAASAA

SEQ ID NO: 605 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYAXQAASAA

SEQ ID NO: 606 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTAAEYAXQAASAA

SEQ ID NO: 607 - protein, 14 aa, Artificial Sequence
  Description of Artificial Sequence: Synthetic peptide
  N-term Ac
  MOD_RES (4)..(4): Alpha-Me R8-octenyl-alanine olefin amino acid that is not connected by a crosslinker
  MOD_RES (8)..(8): Cou7
  MOD_RES (10)..(10): Cyclobutyl-Ala
  MOD_RES (11)..(11): Alpha-Me S5-pentenyl-alanine olefin amino acid that is not connected by a crosslinker
  C-term NH2
LTFAEYWXQAASAA

SEQ ID NO: 608 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWXQLAAAAAAA

SEQ ID NO: 609 - protein, 17 aa, Artificial Sequence
  Description of Artificial Sequence: Synthetic peptide
  N-term Ac
  MOD_RES (4)..(4): Alpha-Me R8-octenyl-alanine olefin amino acid that is not connected by a crosslinker
  MOD_RES (8)..(8): Cou7
  MOD_RES (11)..(11): Alpha-Me S5-pentenyl-alanine olefin amino acid that is not connected by a crosslinker
  MOD_RES (17)..(17): D-amino acid
  C-term NH2
LTFAEYWXQLAAAAAAA

SEQ ID NO: 610 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (11)..(11): Alpha-Me S5-pentenyl-alanine olefin amino acid connected by an all-carbon crosslinker comprising one double bond
  C-term OH
LTFAEYWXQLAAAAAA

SEQ ID NO: 611 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (11)..(11): Alpha-Me S5-pentenyl-alanine olefin amino acid connected by an all-carbon crosslinker comprising one double bond
  C-term OH
LTFAEYWXQLAAAAA

SEQ ID NO: 612 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (11)..(11): Alpha-Me S5-pentenyl-alanine olefin amino acid connected by an all-carbon crosslinker comprising one double bond
  C-term OH
LTFAEYWXQLAAAA

SEQ ID NO: 613 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (11)..(11): Alpha-Me S5-pentenyl-alanine olefin amino acid connected by an all-carbon crosslinker comprising one double bond
  C-term OH
LTFAEYWXQLAAA

SEQ ID NO: 614 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (11)..(11): Alpha-Me S5-pentenyl-alanine olefin amino acid connected by an all-carbon crosslinker comprising one double bond
  C-term OH
LTFAEYWXQLAA

SEQ ID NO: 615 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAASA

SEQ ID NO: 616 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYWAALAAAAAAA

SEQ ID NO: 617 - protein, 18 aa, Artificial Sequence
  Description of Artificial Sequence: Synthetic peptide
  N-term Biotin
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTFAEYWAQLAAAAAAA

SEQ ID NO: 618 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHAWAQLAS

SEQ ID NO: 619 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASA

SEQ ID NO: 620 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAHYWAQAASAA

SEQ ID NO: 621 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFASYWAQAASAA

SEQ ID NO: 622 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFARYWAQAASAA

SEQ ID NO: 623 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAKYWAQAASAA

SEQ ID NO: 624 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAAAAA

SEQ ID NO: 625 - protein, 19 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  MOD_RES (18)..(18): Beta-Ala
  C-term NH2
LTFAEYWAQLAAAAAAAAC

SEQ ID NO: 626 - protein, 19 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(18): D-amino acid
  MOD_RES (19)..(19): Peg4C
  C-term NH2
LTFAEYWAQLAAAAAAADC

SEQ ID NO: 627 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTAAAYWAALAAAAAAA

SEQ ID NO: 628 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYAAALAAAAAAA

SEQ ID NO: 629 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTFAAYWAALAAAAAAA

SEQ ID NO: 630 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTAAAYWAQLAAAAAAA

SEQ ID NO: 631 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYAAQLAAAAAAA

SEQ ID NO: 632 - protein, 17 aa, Artificial Sequence
  Description of Artificial Sequence: Synthetic peptide
  N-term Ac
  MOD_RES (4)..(4): Alpha-Me R6-hexynyl-alanine alkynyl amino acids, crosslink via a dialkyne bond with a second alkynyl amino acid
  misc_feature (4)..(11): Crosslink between residues
  MOD_RES (11)..(11): Alpha-Me S5-pentynyl-alanine alkynyl amino acids, wherein the alkyne forms one half of a dialkyne bond with a second alkynyl amino acid
  MOD_RES (17)..(17): D-amino acid
  C-term NH2
LTFAAYWAALAAAAAAA

SEQ ID NO: 633 - protein, 18 aa, Artificial Sequence
  Description of Artificial Sequence: Synthetic peptide
  N-term FITC
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTFAEYWAQLAAAAAAA

SEQ ID NO: 634 - protein, 15 aa, Artificial Sequence
  Description of Artificial Sequence: Synthetic peptide
  N-term FITC
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTFAEYWAQAASAA

SEQ ID NO: 635 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAEAAAAA

SEQ ID NO: 636 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYWAQLAEAAAAA

SEQ ID NO: 637 - protein, 19 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  MOD_RES (18)..(18): Beta-Ala
  MOD_RES (19)..(19): Lys-bio
  C-term NH2
LTFAEYWAQLAAAAAAAAK

SEQ ID NO: 638 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYWAALAAAAAAA

SEQ ID NO: 639 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYAAALAAAAAAA

SEQ ID NO: 640 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYAAQLAAAAAAA

SEQ ID NO: 641 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAEAAAAA

SEQ ID NO: 642 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYWAQLAEAAAAA

SEQ ID NO: 643 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQAASAAAAA

SEQ ID NO: 644 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Two pentenyl-alanine olefin side chains, each of which is crosslinked to another amino acid as indicated
  misc_feature (11)..(14): Crosslink between residues
  MOD_RES (15)..(15): Alpha-Me R5-pentenyl-alanine olefin amino acid connected by an all-carbon crosslinker comprising one double bond
  C-term NH2
LTFAEYWAQLAAAAAAA

SEQ ID NO: 645 - protein, 18 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): Alpha-Me S5-pentenyl-alanine olefin amino acid connected by an all-carbon crosslinker comprising one double bond
  misc_feature (13)..(17): Crosslink between residues
  MOD_RES (17)..(17): Alpha-Me S5-pentenyl-alanine olefin amino acid connected by an all-carbon crosslinker comprising one double bond
  C-term NH2
LTFAEYWAQLAAAAAAAA

SEQ ID NO: 646 - protein, 19 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Alpha-Me S5-pentenyl-alanine olefin amino acid connected by an all-carbon crosslinker comprising one double bond
  misc_feature (14)..(18): Crosslink between residues
  MOD_RES (18)..(18): Alpha-Me S5-pentenyl-alanine olefin amino acid connected by an all-carbon crosslinker comprising one double bond
  C-term NH2
LTFAEYWAQLAAAAAAAAA

SEQ ID NO: 647 - protein, 20 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): Alpha-Me S5-pentenyl-alanine olefin amino acid connected by an all-carbon crosslinker comprising one double bond
  misc_feature (15)..(19): Crosslink between residues
  MOD_RES (19)..(19): Alpha-Me S5-pentenyl-alanine olefin amino acid connected by an all-carbon crosslinker comprising one double bond
  C-term NH2
LTFAEYWAQLAAAAAAAAAA

SEQ ID NO: 648 - protein, 17 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term OH
AAALTFAEYWAQLAAAA

SEQ ID NO: 649 - protein, 17 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
AAALTFAEYWAQLAAAA

SEQ ID NO: 650 - protein, 18 aa, Artificial Sequence
  Description of Artificial Sequence: Synthetic peptide
  N-term Ac
  MOD_RES (8)..(8): Alpha-Me R8-octenyl-alanine olefin amino acid connected by an all-carbon crosslinker comprising one double bond
  misc_feature (8)..(15): Crosslink between residues
  MOD_RES (15)..(15): Alpha-Me S5-pentenyl-alanine olefin amino acid connected by an all-carbon crosslinker comprising one double bond
  C-term NH2
AAAALTFAEYWAQLAAAA

SEQ ID NO: 651 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  misc_feature (9)..(16): Crosslink between residues
  MOD_RES (16)..(16): Alpha-Me S5-pentenyl-alanine olefin amino acid connected by an all-carbon crosslinker comprising one double bond
  C-term NH2
AAAAALTFAEYWAQLAAAA

SEQ ID NO: 652 - protein, 20 aa, Artificial Sequence
  Description of Artificial Sequence: Synthetic peptide
  N-term Ac
  MOD_RES (10)..(10): Alpha-Me R8-octenyl-alanine olefin amino acid connected by an all-carbon crosslinker comprising one double bond
  misc_feature (10)..(17): Crosslink between residues
  MOD_RES (17)..(17): Alpha-Me S5-pentenyl-alanine olefin amino acid connected by an all-carbon crosslinker comprising one double bond
  C-term NH2
AAAAAALTFAEYWAQLAAAA

SEQ ID NO: 653 - protein, 14 aa, Artificial Sequence
  Description of Artificial Sequence: Synthetic peptide
  N-term Ac
  MOD_RES (4)..(4): Alpha-Me R6-hexynyl-alanine alkynyl amino acids, crosslink via a dialkyne bond with a second alkynyl amino acid
  misc_feature (4)..(11): Crosslink between residues
  MOD_RES (10)..(10): Cyclobutyl-Ala
  MOD_RES (11)..(11): Alpha-Me S6-hexynyl-alanine alkynyl amino acid wherein the alkyne forms one half of a dialkyne bond with a second alkynyl amino acid
  C-term NH2
LTFAEYWAQAASAA

SEQ ID NO: 654 - protein, 12 aa, Artificial Sequence
  Description of Artificial Sequence: Synthetic peptide
  N-term Ac
  MOD_RES (1)..(1): D-amino acid
  MOD_RES (2)..(2): Alpha-Me R5-pentenyl-alanine olefin amino acid connected by an all-carbon crosslinker comprising one double bond
  misc_feature (2)..(6): Crosslink between residues
  MOD_RES (3)..(5): D-amino acid
  MOD_RES (6)..(6): Alpha-Me R5-pentenyl-alanine olefin amino acid connected by an all-carbon crosslinker comprising one double bond
  MOD_RES (7)..(7): D-Phe-4CF3
  MOD_RES (8)..(12): D-amino acid
  C-term NH2
TAWYAAFEKLLR

SEQ ID NO: 655 - protein, 12 aa, Artificial Sequence
  Description of Artificial Sequence: Synthetic peptide
  N-term Ac
  MOD_RES (1)..(4): D-amino acid
  MOD_RES (5)..(5): Alpha-Me R5-pentenyl-alanine olefin amino acid connected by an all-carbon crosslinker comprising one double bond
  misc_feature (5)..(9): Crosslink between residues
  MOD_RES (6)..(6): D-amino acid
  MOD_RES (7)..(7): D-Phe-4CF3
  MOD_RES (8)..(8): D-amino acid
  MOD_RES (9)..(9): Alpha-Me R5-pentenyl-alanine olefin amino acid connected by an all-carbon crosslinker comprising one double bond
  MOD_RES (10)..(12): D-amino acid
  C-term NH2
TAWYANFEALLR

SEQ ID NO: 656 - protein, 12 aa, Artificial Sequence
  Description of Artificial Sequence: Synthetic peptide
  N-term Ac
  MOD_RES (1)..(5): D-amino acid
  MOD_RES (6)..(6): Alpha-Me R5-pentenyl-alanine olefin amino acid connected by an all-carbon crosslinker comprising one double bond
  misc_feature (6)..(10): Crosslink between residues
  MOD_RES (7)..(7): D-Phe-4CF3
  MOD_RES (8)..(9): D-amino acid
  MOD_RES (10)..(10): Alpha-Me R5-pentenyl-alanine olefin amino acid connected by an all-carbon crosslinker comprising one double bond
  MOD_RES (11)..(12): D-amino acid
  C-term NH2
TAWYAAFEKALR

SEQ ID NO: 657 - protein, 14 aa, Artificial Sequence
  Description of Artificial Sequence: Synthetic peptide
  N-term Ac
  MOD_RES (1)..(6): D-amino acid
  MOD_RES (7)..(7): D-Phe-4CF3
  MOD_RES (8)..(8): D-amino acid
  MOD_RES (9)..(9): Alpha-Me R5-pentenyl-alanine olefin amino acid connected by an all-carbon crosslinker comprising one double bond
  misc_feature (9)..(13): Crosslink between residues
  MOD_RES (10)..(12): D-amino acid
  MOD_RES (13)..(13): Alpha-Me R5-pentenyl-alanine olefin amino acid connected by an all-carbon crosslinker comprising one double bond
  MOD_RES (14)..(14): D-amino acid
  C-term NH2
TAWYANFEALLRAA

SEQ ID NO: 658 - protein, 12 aa, Artificial Sequence
  Description of Artificial Sequence: Synthetic peptide
  N-term Ac
  MOD_RES (1)..(1): D-amino acid
  MOD_RES (2)..(2): Alpha-Me S8-octenyl-alanine olefin amino acid connected by an all-carbon crosslinker comprising one double bond
  misc_feature (2)..(9): Crosslink between residues
  MOD_RES (3)..(6): D-amino acid
  MOD_RES (7)..(7): D-Phe-4CF3
  MOD_RES (8)..(8): D-amino acid
  MOD_RES (9)..(9): Alpha-Me R5-pentenyl-alanine olefin amino acid connected by an all-carbon crosslinker comprising one double bond
  MOD_RES (10)..(12): D-amino acid
  C-term NH2
TAWYANFEALLR

SEQ ID NO: 659 - protein, 13 aa, Artificial Sequence
  Description of Artificial Sequence: Synthetic peptide
  N-term Ac
  MOD_RES (1)..(4): D-amino acid
  MOD_RES (5)..(5): Alpha-Me S8-octenyl-alanine olefin amino acid connected by an all-carbon crosslinker comprising one double bond
  misc_feature (5)..(12): Crosslink between residues
  MOD_RES (6)..(6): D-amino acid
  MOD_RES (7)..(7): D-Phe-4CF3
  MOD_RES (8)..(11): D-amino acid
  MOD_RES (12)..(12): Alpha-Me R5-pentenyl-alanine olefin amino acid connected by an all-carbon crosslinker comprising one double bond
  MOD_RES (13)..(13): D-amino acid
  C-term NH2
TAWYANFEKLLAA

SEQ ID NO: 660 - protein, 14 aa, Artificial Sequence
  Description of Artificial Sequence: Synthetic peptide
  N-term Ac
  MOD_RES (1)..(5): D-amino acid
  MOD_RES (6)..(6): Alpha-Me S8-octenyl-alanine olefin amino acid connected by an all-carbon crosslinker comprising one double bond
  misc_feature (6)..(13): Crosslink between residues
  MOD_RES (7)..(7): D-Phe-4CF3
  MOD_RES (8)..(12): D-amino acid
  MOD_RES (13)..(13): Alpha-Me R5-pentenyl-alanine olefin amino acid connected by an all-carbon crosslinker comprising one double bond
  MOD_RES (14)..(14): D-amino acid
  C-term NH2
TAWYAAFEKLLRAA

SEQ ID NO: 661 - protein, 13 aa, Artificial Sequence
  Description of Artificial Sequence: Synthetic peptide
  N-term Ac
  MOD_RES (1)..(4): D-amino acid
  MOD_RES (5)..(5): Alpha-Me S8-octenyl-alanine olefin amino acid connected by an all-carbon crosslinker comprising one double bond
  misc_feature (5)..(12): Crosslink between residues
  MOD_RES (6)..(11): D-amino acid
  MOD_RES (12)..(12): Alpha-Me R5-pentenyl-alanine olefin amino acid connected by an all-carbon crosslinker comprising one double bond
  MOD_RES (13)..(13): D-amino acid
  C-term NH2
TAWYANAEKLLAA

SEQ ID NO: 662 - protein, 14 aa, Artificial Sequence
  Description of Artificial Sequence: Synthetic peptide
  N-term 5-FAM
  MOD_RES (1)..(1): Beta-Ala
  MOD_RES (2)..(5): D-amino acid
  MOD_RES (6)..(6): Alpha-Me S8-octenyl-alanine olefin amino acid connected by an all-carbon crosslinker comprising one double bond
  misc_feature (6)..(13): Crosslink between residues
  MOD_RES (7)..(7): D-amino acid
  MOD_RES (8)..(8): D-Phe-4CF3
  MOD_RES (9)..(12): D-amino acid
  MOD_RES (13)..(13): Alpha-Me R5-pentenyl-alanine olefin amino acid connected by an all-carbon crosslinker comprising one double bond
  MOD_RES (14)..(14): D-amino acid
  C-term NH2
ATAWYANFEKLLAA

SEQ ID NO: 663 - protein, 14 aa, Artificial Sequence
  Description of Artificial Sequence: Synthetic peptide
  N-term 5-FAM
  MOD_RES (1)..(1): Beta-Ala
  MOD_RES (2)..(5): D-amino acid
  MOD_RES (6)..(6): Alpha-Me S8-octenyl-alanine olefin amino acid connected by an all-carbon crosslinker comprising one double bond
  misc_feature (6)..(13): Crosslink between residues
  MOD_RES (7)..(12): D-amino acid
  MOD_RES (13)..(13): Alpha-Me R5-pentenyl-alanine olefin amino acid connected by an all-carbon crosslinker comprising one double bond
  MOD_RES (14)..(14): D-amino acid
  C-term NH2
ATAWYANAEKLLAA

SEQ ID NO: 664 - protein, 13 aa, Artificial Sequence
  Description of Artificial Sequence: Synthetic peptide
  N-term Ac
  MOD_RES (1)..(4): D-amino acid
  MOD_RES (5)..(5): Alpha-Me S8-octenyl-alanine olefin amino acid connected by an all-carbon crosslinker comprising one double bond
  misc_feature (5)..(12): Crosslink between residues
  MOD_RES (6)..(6): D-amino acid
  MOD_RES (7)..(7): D-Phe-4CF3
  MOD_RES (8)..(11): D-amino acid
  MOD_RES (12)..(12): Alpha-Me R5-pentenyl-alanine olefin amino acid connected by an all-carbon crosslinker comprising one double bond
  MOD_RES (13)..(13): D-amino acid
  C-term NH2
TAWYANFEALLAA

SEQ ID NO: 665 - protein, 17 aa, Artificial Sequence
  Description of Artificial Sequence: Synthetic peptide
  N-term Ac
  MOD_RES (1)..(4): D-amino acid
  MOD_RES (5)..(5): Alpha-Me S8-octenyl-alanine olefin amino acid connected by an all-carbon crosslinker comprising one double bond
  misc_feature (5)..(12): Crosslink between residues
  MOD_RES (6)..(6): D-amino acid
  MOD_RES (7)..(7): D-Phe-4CF3
  MOD_RES (8)..(11): D-amino acid
  MOD_RES (12)..(12): Alpha-Me R5-pentenyl-alanine olefin amino acid connected by an all-carbon crosslinker comprising one double bond
  MOD_RES (13)..(17): D-amino acid
  C-term NH2
TAWYANFEKLLAAAAAA

SEQ ID NO: 666 - protein, 17 aa, Artificial Sequence
  Description of Artificial Sequence: Synthetic peptide
  N-term Ac
  MOD_RES (1)..(4): D-amino acid
  MOD_RES (5)..(5): Alpha-Me S8-octenyl-alanine olefin amino acid connected by an all-carbon crosslinker comprising one double bond
  misc_feature (5)..(12): Crosslink between residues
  MOD_RES (6)..(6): D-amino acid
  MOD_RES (7)..(7): D-Phe-4CF3
  MOD_RES (8)..(11): D-amino acid
  MOD_RES (12)..(12): Alpha-Me R5-pentenyl-alanine olefin amino acid connected by an all-carbon crosslinker comprising one double bond
  MOD_RES (13)..(17): D-amino acid
  C-term NH2
TAWYANFEALLAAAAAA

SEQ ID NO: 667 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEFWAQAASALA

SEQ ID NO: 668 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 669 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 670 - protein, 20 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  MOD_RES (20)..(20): D-amino acid
  C-term NH2
AAALTFAEYWAQLAAAAAAA

SEQ ID NO: 671 - protein, 17 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 672 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): 2-aminoisobutyric acid
  MOD_RES (17)..(17): D-amino acid
  C-term NH2
LTFAEYWAQLAAXAAAA

SEQ ID NO: 673 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): 2-aminoisobutyric acid
  MOD_RES (17)..(17): D-amino acid
  C-term NH2
LTFAEYWAQLAAAAXAA

SEQ ID NO: 674 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (16)..(16): 2-aminoisobutyric acid
  MOD_RES (17)..(17): D-amino acid
  C-term NH2
LTFAEYWAQLAAAAAXA

SEQ ID NO: 675 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): 2-aminoisobutyric acid
  C-term NH2
LTFAEYWAQLAAAAAAX

SEQ ID NO: 676 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (16)..(17): D-amino acid
  C-term NH2
LTFAEYWAQLAAAAAAA

SEQ ID NO: 677 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLAAAAAAA

SEQ ID NO: 678 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): Sarcosine
  C-term NH2
LTFAEYWAQLAAAAAAX

SEQ ID NO: 679 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term OH
LTFAEYWAQLAAAAAAA

SEQ ID NO: 680 - protein, 17 aa, Artificial Sequence
  Description of Artificial Sequence: Synthetic peptide
  N-term Ac
  MOD_RES (4)..(4): Alpha-Me R6-hexynyl-alanine alkynyl amino acids, crosslink via a dialkyne bond with a second alkynyl amino acid
  misc_feature (4)..(11): Crosslink between residues
  MOD_RES (11)..(11): Alpha-Me S5-pentynyl-alanine alkynyl amino acids, wherein the alkyne forms one half of a dialkyne bond with a second alkynyl amino acid
  MOD_RES (17)..(17): D-amino acid
  C-term NH2
LTFAAYWAQLAAAAAAA

SEQ ID NO: 681 - protein, 15 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTFAEYWAQAASAA

SEQ ID NO: 682 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEFWAQAAAAAAAA

SEQ ID NO: 683 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQAAAAAAAA

SEQ ID NO: 684 - protein, 16 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  MOD_RES (16)..(16): D-amino acid
  C-term NH2
TFAEYWAQLAAAAAAA

SEQ ID NO: 685 - protein, 15 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (15)..(15): D-amino acid
  C-term NH2
FAEYWAQLAAAAAAA

SEQ ID NO: 686 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LVFAEYWAQLAAAAAAA

SEQ ID NO: 687 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
AAFAEYWAQLAAAAAAA

SEQ ID NO: 688 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (16)..(16): D-amino acid
  C-term NH2
LTFAEYWAQLAAAAAA

SEQ ID NO: 689 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQLAAAAA

SEQ ID NO: 690 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): D-amino acid
  C-term NH2
LTFAEYWAQLAAAA

SEQ ID NO: 691 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): D-amino acid
  C-term NH2
LTFAEYWAQLAAA

SEQ ID NO: 692 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (12)..(12): D-amino acid
  C-term NH2
LTFAEYWAQLAA

SEQ ID NO: 693 - protein, 16 aa, Artificial Sequence
  Description of Artificial Sequence: Synthetic peptide
  MOD_RES (2)..(2): Alpha-Me R5-pentenyl-alanine olefin amino acid connected by an all-carbon crosslinker comprising one double bond
  misc_feature (2)..(9): Crosslink between residues
  MOD_RES (9)..(9): Alpha-Me S8-octenyl-alanine olefin amino acid connected by an all-carbon crosslinker comprising one double bond
LAQETFSDAWKLLPEN

SEQ ID NO: 694 - protein, 16 aa, Artificial Sequence
  Description of Artificial Sequence: Synthetic peptide
  MOD_RES (4)..(4): Alpha-Me R5-pentenyl-alanine olefin amino acid connected by an all-carbon crosslinker comprising one double bond
  misc_feature (4)..(11): Crosslink between residues
  MOD_RES (11)..(11): Alpha-Me S8-octenyl-alanine olefin amino acid connected by an all-carbon crosslinker comprising one double bond
LSQATFSDLWALLPEN

SEQ ID NO: 695 - protein, 16 aa, Artificial Sequence
  Description of Artificial Sequence: Synthetic peptide
  MOD_RES (5)..(5): Alpha-Me R5-pentenyl-alanine olefin amino acid connected by an all-carbon crosslinker comprising one double bond
  misc_feature (5)..(12): Crosslink between residues
  MOD_RES (12)..(12): Alpha-Me S8-octenyl-alanine olefin amino acid connected by an all-carbon crosslinker comprising one double bond
LSQEAFSDLWKALPEN

SEQ ID NO: 696 - protein, 16 aa, Artificial Sequence
  Description of Artificial Sequence: Synthetic peptide
  MOD_RES (6)..(6): Alpha-Me R5-pentenyl-alanine olefin amino acid connected by an all-carbon crosslinker comprising one double bond
  misc_feature (6)..(13): Crosslink between residues
  MOD_RES (13)..(13): Alpha-Me S8-octenyl-alanine olefin amino acid connected by an all-carbon crosslinker comprising one double bond
LSQETASDLWKLAPEN

SEQ ID NO: 697 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
LSQETFADLWKLLAEN

SEQ ID NO: 698 - protein, 16 aa, Artificial Sequence
  Description of Artificial Sequence: Synthetic peptide
  MOD_RES (2)..(2): Any amino acid
  MOD_RES (8)..(8): Alpha-Me R5-pentenyl-alanine olefin amino acid connected by an all-carbon crosslinker comprising one double bond
  misc_feature (8)..(15): Crosslink between residues
  MOD_RES (15)..(15): Alpha-Me S8-octenyl-alanine olefin amino acid connected by an all-carbon crosslinker comprising one double bond
LXQETFSALWKLLPAN

SEQ ID NO: 699 - protein, 16 aa, Artificial Sequence
  Description of Artificial Sequence: Synthetic peptide
  MOD_RES (9)..(9): Alpha-Me R5-pentenyl-alanine olefin amino acid connected by an all-carbon crosslinker comprising one double bond
  misc_feature (9)..(16): Crosslink between residues
  MOD_RES (16)..(16): Alpha-Me S8-octenyl-alanine olefin amino acid connected by an all-carbon crosslinker comprising one double bond
LSQETFSDAWKLLPEA

SEQ ID NO: 700 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
LSQQTFADLWKLLAEN

SEQ ID NO: 701 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
LSQETFADLWKLLAQN

SEQ ID NO: 702 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
LSQQTFADLWKLLAQN

SEQ ID NO: 703 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
LSQETFANLWKLLAQN

SEQ ID NO: 704 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
LSQQTFANLWKLLAQN

SEQ ID NO: 705 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
LSQQTFANLWRLLAQN

SEQ ID NO: 706 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
QSQQTFANLWKLLAQN

SEQ ID NO: 707 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
QSQQTFANLWRLLAQN

SEQ ID NO: 708 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
QSQQTAANLWRLLAQN

SEQ ID NO: 709 - protein, 16 aa, Artificial Sequence
  Description of Artificial Sequence: Synthetic peptide
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
LAQETFSDAWKLLPEN

SEQ ID NO: 710 - protein, 16 aa, Artificial Sequence
  Description of Artificial Sequence: Synthetic peptide
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
LSQATFSDLWALLPEN

SEQ ID NO: 711 - protein, 16 aa, Artificial Sequence
  Description of Artificial Sequence: Synthetic peptide
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
LSQEAFSDLWKALPEN

SEQ ID NO: 712 - protein, 16 aa, Artificial Sequence
  Description of Artificial Sequence: Synthetic peptide
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (13)..(13): Alpha-Me S5-pentenyl-alanine olefin amino acid connected by an all-carbon crosslinker comprising one double bond
LSQETASDLWKLAPEN

SEQ ID NO: 713 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
LSQETFADLWKLLAEN

SEQ ID NO: 714 - protein, 16 aa, Artificial Sequence
  Description of Artificial Sequence: Synthetic peptide
  MOD_RES (2)..(2): Any amino acid
  MOD_RES (8)..(8): Alpha-Me R8-octenyl-alanine olefin amino acid connected by an all-carbon crosslinker comprising one double bond
  misc_feature (8)..(15): Crosslink between residues
  MOD_RES (15)..(15): Alpha-Me S5-pentenyl-alanine olefin amino acid connected by an all-carbon crosslinker comprising one double bond
LXQETFSALWKLLPAN

SEQ ID NO: 715 - protein, 16 aa, Artificial Sequence
  Description of Artificial Sequence: Synthetic peptide
  MOD_RES (9)..(9): Alpha-Me R8-octenyl-alanine olefin amino acid connected by an all-carbon crosslinker comprising one double bond
  misc_feature (9)..(16): Crosslink between residues
  MOD_RES (16)..(16): Alpha-Me S5-pentenyl-alanine olefin amino acid connected by an all-carbon crosslinker comprising one double bond
LSQETFSDAWKLLPEA

SEQ ID NO: 716 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
LSQQTFADLWKLLAEN

SEQ ID NO: 717 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
LSQETFADLWKLLAQN

SEQ ID NO: 718 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
LSQQTFADLWKLLAQN

SEQ ID NO: 719 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
LSQETFANLWKLLAQN

SEQ ID NO: 720 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
LSQQTFANLWKLLAQN

SEQ ID NO: 721 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
LSQQTFANLWRLLAQN

SEQ ID NO: 722 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
QSQQTFANLWKLLAQN

SEQ ID NO: 723 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
QSQQTFANLWRLLAQN

SEQ ID NO: 724 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
QSQQTAANLWRLLAQN

SEQ ID NO: 725 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
QSQQTFANLWRKKAQN

SEQ ID NO: 726 - protein, 14 aa, Artificial Sequence
  Description of Artificial Sequence: Synthetic peptide
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
QQTFADLWRLLAEN

SEQ ID NO: 727 - protein, 12 aa, Artificial Sequence
  Description of Artificial Sequence: Synthetic peptide
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
QQTFADLWRLLA

SEQ ID NO: 728 - protein, 13 aa, Artificial Sequence
  Description of Artificial Sequence: Synthetic peptide
  MOD_RES (7)..(7): Alpha-Me S5-pentenyl-alanine olefin amino acid connected by an all-carbon crosslinker comprising one double bond
  misc_feature (7)..(11): Crosslink between residues
  MOD_RES (11)..(11): Alpha-Me S5-pentenyl-alanine olefin amino acid connected by an all-carbon crosslinker comprising one double bond
LSQQTFADLWALL

SEQ ID NO: 729 - protein, 11 aa, Artificial Sequence
  Description of Artificial Sequence: Synthetic peptide
  MOD_RES (5)..(5): Alpha-Me S5-pentenyl-alanine olefin amino acid connected by an all-carbon crosslinker comprising one double bond
  misc_feature (5)..(9): Crosslink between residues
  MOD_RES (9)..(9): Alpha-Me S5-pentenyl-alanine olefin amino acid connected by an all-carbon crosslinker comprising one double bond
QQTFADLWALL

SEQ ID NO: 730 - protein, 14 aa, Artificial Sequence
  Description of Artificial Sequence: Synthetic peptide
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
QQTAADLWRLLAEN

SEQ ID NO: 731 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
QSQQTFANLWRLLAQN

SEQ ID NO: 732 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
QSQQTAANLWRLLAQN

SEQ ID NO: 733 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
QSQQTFADLWRLLAQN

SEQ ID NO: 734 - protein, 11 aa, Artificial Sequence
  Description of Artificial Sequence: Synthetic peptide
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
QTFANLWRLLA

SEQ ID NO: 735 - protein, 16 aa, Artificial Sequence
  Description of Artificial Sequence: Synthetic peptide
  MOD_RES (7)..(7): Alpha-Me S5-pentenyl-alanine olefin amino acid connected by an all-carbon crosslinker comprising one double bond
  misc_feature (7)..(11): Crosslink between residues
  MOD_RES (11)..(11): Alpha-Me S5-pentenyl-alanine olefin amino acid connected by an all-carbon crosslinker comprising one double bond
QSQQTFANLWALLPQN

SEQ ID NO: 736 - protein, 16 aa, Artificial Sequence
  Description of Artificial Sequence: Synthetic peptide
  MOD_RES (3)..(3): Alpha-Me S5-pentenyl-alanine olefin amino acid connected by an all-carbon crosslinker comprising one double bond
  misc_feature (3)..(7): Crosslink between residues
  MOD_RES (7)..(7): Alpha-Me S5-pentenyl-alanine olefin amino acid connected by an all-carbon crosslinker comprising one double bond
QSAQTFANLWRLLPQN

SEQ ID NO: 737 - protein, 10 aa, Artificial Sequence
  Description of Artificial Sequence: Synthetic peptide
  MOD_RES (1)..(1): Alpha-Me S5-pentenyl-alanine olefin amino acid connected by an all-carbon crosslinker comprising one double bond
  misc_feature (1)..(5): Crosslink between residues
  MOD_RES (5)..(5): Alpha-Me S5-pentenyl-alanine olefin amino acid connected by an all-carbon crosslinker comprising one double bond
ATFSALWKLL

SEQ ID NO: 738 - protein, 10 aa, Artificial Sequence
  Description of Artificial Sequence: Synthetic peptide
  MOD_RES (4)..(4): Alpha-Me S5-pentenyl-alanine olefin amino acid connected by an all-carbon crosslinker comprising one double bond
  misc_feature (4)..(8): Crosslink between residues
  MOD_RES (8)..(8): Alpha-Me S5-pentenyl-alanine olefin amino acid connected by an all-carbon crosslinker comprising one double bond
ETFADLWALL

SEQ ID NO: 739 - protein, 10 aa, Artificial Sequence
  Description of Artificial Sequence: Synthetic peptide
  MOD_RES (4)..(4): Alpha-Me S5-pentenyl-alanine olefin amino acid connected by an all-carbon crosslinker comprising one double bond
  misc_feature (4)..(8): Crosslink between residues
  MOD_RES (8)..(8): Alpha-Me S5-pentenyl-alanine olefin amino acid connected by an all-carbon crosslinker comprising one double bond
QTFANLWALL

SEQ ID NO: 740 - protein, 13 aa, Artificial Sequence
  Description of Artificial Sequence: Synthetic peptide
  MOD_RES (1)..(1): Alpha-Me S5-pentenyl-alanine olefin amino acid connected by an all-carbon crosslinker comprising one double bond
  misc_feature (1)..(5): Crosslink between residues
  MOD_RES (5)..(5): Alpha-Me S5-pentenyl-alanine olefin amino acid connected by an all-carbon crosslinker comprising one double bond
ASQEAFSNLWKLL

SEQ ID NO: 741 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
LSQETFADLWKLLAEN

SEQ ID NO: 742 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
LSQETFANLWKLLAQN

SEQ ID NO: 743 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
LSQQTFANLWRLLAQN

SEQ ID NO: 744 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTFANLWKLLAQN

SEQ ID NO: 745 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTFANLWRLLAQN

SEQ ID NO: 746 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTAANLWRLLAQN

SEQ ID NO: 747 - protein, 16 aa, Artificial Sequence
  Description of Artificial Sequence: Synthetic peptide
  N-term Ac
  MOD_RES (2)..(2): 2-aminoisobutyric acid
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QXQQTFANLWRLLAQN

SEQ ID NO: 748 - protein, 16 aa, Artificial Sequence
  Description of Artificial Sequence: Synthetic peptide
  N-term Ac
  C-term NH2
QSQQTFSNLWRLLPQN

SEQ ID NO: 749 - protein, 16 aa, Artificial Sequence
  Description of Artificial Sequence: Synthetic peptide
  N-term Ac
  MOD_RES (7)..(7): Alpha-Me R8-octenyl-alanine olefin amino acid that is not connected by a crosslinker
  MOD_RES (14)..(14): Alpha-Me S5-pentenyl-alanine olefin amino acid that is not connected by a crosslinker
  C-term NH2
QSQQTFANLWRLLAQN

SEQ ID NO: 750 - protein, 16 aa, Artificial Sequence
  Description of Artificial Sequence: Synthetic peptide
  N-term Ac
  MOD_RES (4)..(4): 2-aminoisobutyric acid
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQXTFANLWRLLAQN

SEQ ID NO: 751 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTFANLWRLLAAN

SEQ ID NO: 752 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
ASQQTFANLWRLLAQN

SEQ ID NO: 753 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTFAALWRLLAQN

SEQ ID NO: 754 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQETFANLWRLLAQN

SEQ ID NO: 755 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
RSQQTFANLWRLLAQN

SEQ ID NO: 756 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
RSQQTFANLWRLLAEN

SEQ ID NO: 757 - protein, 16 aa, Artificial Sequence
  Description of Artificial Sequence: Synthetic peptide
  N-term Ac
  C-term NH2
LSQETFSDLWKLLPEN

SEQ ID NO: 758 - protein, 16 aa, Artificial Sequence
  Description of Artificial Sequence: Synthetic peptide
  N-term Ac
  MOD_RES (4)..(4): Alpha-Me S5-pentenyl-alanine olefin amino acid connected by an all-carbon crosslinker comprising one double bond
  misc_feature (4)..(8): Crosslink between residues
  MOD_RES (8)..(8): Alpha-Me S5-pentenyl-alanine olefin amino acid connected by an all-carbon crosslinker comprising one double bond
  C-term NH2
QSQATFSALWRLLPQN

SEQ ID NO: 759 - protein, 16 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  misc_feature (5)..(9): Crosslink between residues
  MOD_RES (9)..(9): Alpha-Me S5-pentenyl-alanine olefin amino acid connected by an all-carbon crosslinker comprising one double bond
  C-term NH2
QSQQAFSNAWRLLPQN

SEQ ID NO: 760 - protein, 16 aa, Artificial Sequence
  Description of Artificial Sequence: Synthetic peptide
  N-term Ac
  MOD_RES (6)..(6): Alpha-Me S5-pentenyl-alanine olefin amino acid connected by an all-carbon crosslinker comprising one double bond
  misc_feature (6)..(10): Crosslink between residues
  MOD_RES (10)..(10): Alpha-Me S5-pentenyl-alanine olefin amino acid connected by an all-carbon crosslinker comprising one double bond
  C-term NH2
QSQQTASNLARLLPQN

SEQ ID NO: 761 - protein, 16 aa, Artificial Sequence
  Description of Artificial Sequence: Synthetic peptide
  N-term Ac
  MOD_RES (7)..(7): Alpha-Me S5-pentenyl-alanine olefin amino acid connected by an all-carbon crosslinker comprising one double bond
  misc_feature (7)..(11): Crosslink between residues
  MOD_RES (11)..(11): Alpha-Me S5-pentenyl-alanine olefin amino acid connected by an all-carbon crosslinker comprising one double bond
  C-term NH2
QSQQTFANLWALLPQN

SEQ ID NO: 762 - protein, 19 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (11)..(11): 2-aminoisobutyric acid
  MOD_RES (13)..(13): Norleucine
  MOD_RES (14)..(14): Alpha-Me S5-pentenyl-alanine olefin amino acid connected by an all-carbon crosslinker comprising one double bond
  MOD_RES (17)..(17): 2-aminoisobutyric acid
  C-term NH2
RTQATFANQWXALATNXTR

SEQ ID NO: 763 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTFANLWRLLARN

SEQ ID NO: 764 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQRTFANLWRLLAQN

SEQ ID NO: 765 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (9)..(9): Norleucine
  MOD_RES (14)..(14): Alpha-Me S5-pentenyl-alanine olefin amino acid connected by an all-carbon crosslinker comprising one double bond
  C-term NH2
QSQQTFANLWRLLAQN

SEQ ID NO: 766 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (12)..(12): Norleucine
  MOD_RES (14)..(14): Alpha-Me S5-pentenyl-alanine olefin amino acid connected by an all-carbon crosslinker comprising one double bond
  C-term NH2
QSQQTFANLWRLLAQN

SEQ ID NO: 767 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (13)..(13): Norleucine
  MOD_RES (14)..(14): Alpha-Me S5-pentenyl-alanine olefin amino acid connected by an all-carbon crosslinker comprising one double bond
  C-term NH2
QSQQTFANLWRLLAQN

SEQ ID NO: 768 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTYANLWRLLAQN

SEQ ID NO: 769 - protein, 16 aa, Artificial Sequence
  Description of Artificial Sequence: Synthetic peptide
  N-term Ac
  MOD_RES (2)..(2): 2-aminoisobutyric acid
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
RXQQTFANLWRLLAQN

SEQ ID NO: 770 - protein, 12 aa, Artificial Sequence
  Description of Artificial Sequence: Synthetic peptide
  N-term Ac
  C-term NH2
MPRFMDYWEGLN

SEQ ID NO: 771 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
RSQQRFANLWRLLAQN

SEQ ID NO: 772 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQRFANLWRLLAQN

SEQ ID NO: 773 - protein, 16 aa, Artificial Sequence
  Description of Artificial Sequence: Synthetic peptide
  N-term Ac
  MOD_RES (2)..(2): 2-aminoisobutyric acid
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
RXQQRFANLWRLLAQN

SEQ ID NO: 774 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
RSQQRFANFWRLLAQN

SEQ ID NO: 775 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
RSQQRFANYWRLLAQN

SEQ ID NO: 776 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
RSQQTFANLWQLLAQN

SEQ ID NO: 777 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (12)..(12): Alpha-Me-Leu
  MOD_RES (14)..(14): Alpha-Me S5-pentenyl-alanine olefin amino acid connected by an all-carbon crosslinker comprising one double bond
  C-term NH2
QSQQTFANLWQLLAQN

SEQ ID NO: 778 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (9)..(9): Alpha-Me-Leu
  MOD_RES (14)..(14): Alpha-Me S5-pentenyl-alanine olefin amino acid connected by an all-carbon crosslinker comprising one double bond
  C-term NH2
QSQQTFANLWRLLAQN

SEQ ID NO: 779 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
LPRFADYWEGLAQN

SEQ ID NO: 780 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
LPRFANYWRLLAQN

SEQ ID NO: 781 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
RFANLWRLLAQ

SEQ ID NO: 782 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (9)..(9): 2-fluoro-Phe
  MOD_RES (14)..(14): Alpha-Me S5-pentenyl-alanine olefin amino acid connected by an all-carbon crosslinker comprising one double bond
  C-term NH2
QSQQTFANFWRLLAQN

SEQ ID NO: 783 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (9)..(9): 3-fluoro-Phe
  MOD_RES (14)..(14): Alpha-Me S5-pentenyl-alanine olefin amino acid connected by an all-carbon crosslinker comprising one double bond
  C-term NH2
QSQQTFANFWRLLAQN

SEQ ID NO: 784 - protein, 16 aa, Artificial Sequence
  Description of Artificial Sequence: Synthetic peptide
  N-term Ac
  MOD_RES (7)..(7): Alpha-hydrogen R8-octenyl-alanine olefin amino acid connected by an all-carbon saturated crosslinker with no double bond
  misc_feature (7)..(14): Crosslink between residues
  MOD_RES (14)..(14): Alpha-hydrogen S5-pentenyl-alanine olefin amino acid connected by an all-carbon saturated crosslinker with no double bond
  C-term NH2
QSQQTFANLWRLLAQN

SEQ ID NO: 785 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
RSQQTAANLWRLLAQN

SEQ ID NO: 786 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising no double bonds
  misc_feature (7)..(14): Crosslink between residues
  MOD_RES (14)..(14): Alpha-Me S5-pentenyl-alanine olefin amino acid connected by an all-carbon crosslinker comprising no double bonds
  C-term NH2
QSQQTFANLWRLLAQN

SEQ ID NO: 787 - protein, 16 aa, Artificial Sequence
  Description of Artificial Sequence: Synthetic peptide
  N-term acetylated with heptanoic acid and connected to internal olefin amino acid by an all-carbon crosslinker to position 4 comprising one double bond
  MOD_RES (4)..(4): Alpha-Me S5-pentenyl-alanine olefin amino acid connected by an all-carbon crosslinker to the N-term comprising one double bond
  C-term NH2
QSQATFSNLWRLLPQN

SEQ ID NO: 788 - protein, 16 aa, Artificial Sequence
  Description of Artificial Sequence: Synthetic peptide
  N-term acetylated with heptanoic acid and connected to internal olefin amino acid by an all-carbon crosslinker to position 4 comprising one double bond
  MOD_RES (4)..(4): Alpha-Me S5-pentenyl-alanine olefin amino acid connected by an all-carbon crosslinker to the N-term comprising one double bond
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQATFANLWRLLAQN

SEQ ID NO: 789 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (10)..(10): 6cl-Trp
  MOD_RES (14)..(14): Alpha-Me S5-pentenyl-alanine olefin amino acid connected by an all-carbon crosslinker comprising one double bond
  C-term NH2
QSQQTFANLWRLLAQN

SEQ ID NO: 790 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (10)..(10): Me6cl-Trp
  MOD_RES (14)..(14): Alpha-Me S5-pentenyl-alanine olefin amino acid connected by an all-carbon crosslinker comprising one double bond
  C-term NH2
QSQQTFANLWRLLAQN

SEQ ID NO: 791 - protein, 12 aa, Artificial Sequence
  Description of Artificial Sequence: Synthetic peptide
  N-term Ac
  C-term NH2
LTFEHYWAQLTS

SEQ ID NO: 792 - protein, 12 aa, Artificial Sequence
  Description of Artificial Sequence: Synthetic peptide
  N-term Ac
  MOD_RES (4)..(4): Alpha-Me S5-pentenyl-alanine olefin amino acid connected by an all-carbon crosslinker comprising one double bond
  misc_feature (4)..(8): Crosslink between residues
  MOD_RES (8)..(8): Alpha-Me S5-pentenyl-alanine olefin amino acid connected by an all-carbon crosslinker comprising one double bond
  C-term NH2
LTFAHYWAQLTS

SEQ ID NO: 793 - protein, 12 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  misc_feature (5)..(9): Crosslink between residues
  MOD_RES (9)..(9): Alpha-Me S5-pentenyl-alanine olefin amino acid connected by an all-carbon crosslinker comprising one double bond
  C-term NH2
LTFEAYWAALTS

SEQ ID NO: 794 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one Z configured double bond
  misc_feature (4)..(11): Crosslink between residues
  MOD_RES (11)..(11): Alpha-Me S5-pentenyl-alanine olefin amino acid connected by an all-carbon crosslinker comprising one Z configured double bond
  C-term NH2
LTFAHYWAQLAS

SEQ ID NO: 795 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWRQLAS

SEQ ID NO: 796 - protein, 16 aa, Artificial Sequence
  Description of Artificial Sequence: Synthetic peptide
  N-term Ac
  MOD_RES (3)..(3): Alpha-Me S5-pentenyl-alanine olefin amino acid connected by an all-carbon crosslinker comprising one double bond
  misc_feature (3)..(7): Crosslink between residues
  MOD_RES (7)..(7): Two pentenyl-alanine olefin side chains, each of which is crosslinked to another amino acid as indicated
  misc_feature (7)..(14): Crosslink between residues
  MOD_RES (14)..(14): Alpha-Me S8-octenyl-alanine olefin amino acid connected by an all-carbon crosslinker comprising one double bond
  C-term NH2
QSAQTFANLWRLLAQN

SEQ ID NO: 797 - protein, 16 aa, Artificial Sequence
  Description of Artificial Sequence: Synthetic peptide
  N-term Ac
  C-term NH2
QSQQTASNLWRLLPQN

SEQ ID NO: 798 - protein, 16 aa, Artificial Sequence
  Description of Artificial Sequence: Synthetic peptide
  N-term Ac
  MOD_RES (7)..(7): Alpha-Me R8-octenyl-alanine olefin amino acid that is not connected by a crosslinker
  MOD_RES (14)..(14): Alpha-Me S5-pentenyl-alanine olefin amino acid that is not connected by a crosslinker
  C-term NH2
QSQQTAANLWRLLAQN

SEQ ID NO: 799 - protein, 16 aa, Artificial Sequence
  Description of Artificial Sequence: Synthetic peptide
  N-term Ac
  MOD_RES (7)..(7): Alpha-Me R8-octenyl-alanine olefin amino acid that is not connected by a crosslinker
  MOD_RES (14)..(14): Alpha-Me S5-pentenyl-alanine olefin amino acid that is not connected by a crosslinker
  C-term NH2
ASQQTFANLWRLLAQN

SEQ ID NO: 800 - protein, 16 aa, Artificial Sequence
  Description of Artificial Sequence: Synthetic peptide
  N-term Ac
  MOD_RES (1)..(1): Alpha-Me S5-pentenyl-alanine olefin amino acid connected by an all-carbon crosslinker comprising one double bond
  misc_feature (1)..(5): Crosslink between residues
  MOD_RES (5)..(5): Alpha-Me S5-pentenyl-alanine olefin amino acid connected by an all-carbon crosslinker comprising one double bond
  MOD_RES (14)..(14): 2-aminoisobutyric acid
  C-term NH2
ASQQAFSNLWRLLXQN

SEQ ID NO: 801 - protein, 16 aa, Artificial Sequence
  Description of Artificial Sequence: Synthetic peptide
  N-term Ac
  MOD_RES (3)..(3): Alpha-Me S5-pentenyl-alanine olefin amino acid connected by an all-carbon crosslinker comprising one double bond
  misc_feature (3)..(7): Crosslink between residues
  MOD_RES (7)..(7): Alpha-Me S5-pentenyl-alanine olefin amino acid connected by an all-carbon crosslinker comprising one double bond
  MOD_RES (14)..(14): 2-aminoisobutyric acid
  C-term NH2
QSAQTFANLWRLLXQN

SEQ ID NO: 802 - protein, 16 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  misc_feature (5)..(9): Crosslink between residues
  MOD_RES (9)..(9): Alpha-Me S5-pentenyl-alanine olefin amino acid connected by an all-carbon crosslinker comprising one double bond
  MOD_RES (14)..(14): 2-aminoisobutyric acid
  C-term NH2
QSQQAFSNAWRLLXQN

SEQ ID NO: 803 - protein, 16 aa, Artificial Sequence
  Description of Artificial Sequence: Synthetic peptide
  N-term Ac
  MOD_RES (7)..(7): Alpha-Me S5-pentenyl-alanine olefin amino acid connected by an all-carbon crosslinker comprising one double bond
  misc_feature (7)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): 2-aminoisobutyric acid
  C-term NH2
QSQQTFANLWALLXQN

SEQ ID NO: 804 - protein, 16 aa, Artificial Sequence
  Description of Artificial Sequence: Synthetic peptide
  N-term Ac
  MOD_RES (8)..(8): Alpha-Me S5-pentenyl-alanine olefin amino acid connected by an all-carbon crosslinker comprising one double bond
  misc_feature (8)..(12): Crosslink between residues
  MOD_RES (12)..(12): Alpha-Me S5-pentenyl-alanine olefin amino acid connected by an all-carbon crosslinker comprising one double bond
  MOD_RES (14)..(14): 2-aminoisobutyric acid
  C-term NH2
QSQQTFSALWRALXQN

SEQ ID NO: 805 - protein, 16 aa, Artificial Sequence
  Description of Artificial Sequence: Synthetic peptide
  N-term Ac
  MOD_RES (11)..(11): Alpha-Me S5-pentenyl-alanine olefin amino acid connected by an all-carbon crosslinker comprising one double bond
  misc_feature (11)..(15): Crosslink between residues
  MOD_RES (15)..(15): Alpha-Me S5-pentenyl-alanine olefin amino acid connected by an all-carbon crosslinker comprising one double bond
  C-term NH2
QSQQTFSNLWALLAAN

SEQ ID NO: 806 - protein, 16 aa, Artificial Sequence
  Description of Artificial Sequence: Synthetic peptide
  N-term Ac
  MOD_RES (1)..(1): Alpha-Me S5-pentenyl-alanine olefin amino acid that is not connected by a crosslinker
  MOD_RES (5)..(5): Alpha-Me S5-pentenyl-alanine olefin amino acid that is not connected by a crosslinker
  MOD_RES (14)..(14): 2-aminoisobutyric acid
  C-term NH2
ASQQAFSNLWRLLXQN

SEQ ID NO: 807 - protein, 16 aa, Artificial Sequence
  Description of Artificial Sequence: Synthetic peptide
  N-term Ac
  MOD_RES (3)..(3): Alpha-Me S5-pentenyl-alanine olefin amino acid that is not connected by a crosslinker
  MOD_RES (7)..(7): Alpha-Me S5-pentenyl-alanine olefin amino acid that is not connected by a crosslinker
  MOD_RES (14)..(14): 2-aminoisobutyric acid
  C-term NH2
QSAQTFANLWRLLXQN

SEQ ID NO: 808 - protein, 16 aa, Artificial Sequence
  Description of Artificial Sequence: Synthetic peptide
  N-term Ac
  MOD_RES (5)..(5): Alpha-Me S5-pentenyl-alanine olefin amino acid that is not connected by a crosslinker
  MOD_RES (9)..(9): Alpha-Me S5-pentenyl-alanine olefin amino acid that is not connected by a crosslinker
  MOD_RES (14)..(14): 2-aminoisobutyric acid
  C-term NH2
QSQQAFSNAWRLLXQN

SEQ ID NO: 809 - protein, 16 aa, Artificial Sequence
  Description of Artificial Sequence: Synthetic peptide
  N-term Ac
  MOD_RES (7)..(7): Alpha-Me S5-pentenyl-alanine olefin amino acid that is not connected by a crosslinker
  MOD_RES (11)..(11): Alpha-Me S5-pentenyl-alanine olefin amino acid that is not connected by a crosslinker
  MOD_RES (14)..(14): 2-aminoisobutyric acid
  C-term NH2
QSQQTFANLWALLXQN

SEQ ID NO: 810 - protein, 16 aa, Artificial Sequence
  Description of Artificial Sequence: Synthetic peptide
  N-term Ac
  MOD_RES (4)..(4): Alpha-Me S5-pentenyl-alanine olefin amino acid connected by an all-carbon crosslinker comprising one double bond
  misc_feature (4)..(8): Crosslink between residues
  MOD_RES (8)..(8): Alpha-Me S5-pentenyl-alanine olefin amino acid connected by an all-carbon crosslinker comprising one double bond
  MOD_RES (14)..(14): 2-aminoisobutyric acid
  C-term NH2
QSQATFSALWRLLXQN

SEQ ID NO: 811 - protein, 16 aa, Artificial Sequence
  Description of Artificial Sequence: Synthetic peptide
  N-term Ac
  MOD_RES (4)..(4): Alpha-Me S5-pentenyl-alanine olefin amino acid that is not connected by a crosslinker
  MOD_RES (8)..(8): Alpha-Me S5-pentenyl-alanine olefin amino acid that is not connected by a crosslinker
  MOD_RES (14)..(14): 2-aminoisobutyric acid
  C-term NH2
QSQATFSALWRLLXQN

SEQ ID NO: 812 - protein, 16 aa, Artificial Sequence
  Description of Artificial Sequence: Synthetic peptide
  N-term Ac
  MOD_RES (3)..(3): Alpha-Me S5-pentenyl-alanine olefin amino acid not connected by any crosslinker
  MOD_RES (7)..(7): Amino acid comprising two pentenyl-alanine olefin side chains that are not crosslinked
  MOD_RES (14)..(14): Alpha-Me S8-octenyl-alanine olefin amino acid not connected by any crosslinker
  C-term NH2
QSAQTFANLWRLLAQN

SEQ ID NO: 813 - protein, 16 aa, Artificial Sequence
  Description of Artificial Sequence: Synthetic peptide
  N-term Ac
  MOD_RES (1)..(1): Alpha-Me R8-octenyl-alanine olefin amino acid connected by an all-carbon crosslinker comprising one double bond
  misc_feature (1)..(8): Crosslink between residues
  MOD_RES (8)..(8): Alpha-Me S5-pentenyl-alanine olefin amino acid connected by an all-carbon crosslinker comprising one double bond
  MOD_RES (14)..(14): 2-aminoisobutyric acid
  C-term NH2
ASQQTFSALWRLLXQN

SEQ ID NO: 814 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): 2-aminoisobutyric acid
  C-term NH2
QSQATFSNLWALLXQN

SEQ ID NO: 815 - protein, 16 aa, Artificial Sequence
  Description of Artificial Sequence: Synthetic peptide
  N-term Ac
  MOD_RES (8)..(8): Alpha-Me R8-octenyl-alanine olefin amino acid connected by an all-carbon crosslinker comprising one double bond
  misc_feature (8)..(15): Crosslink between residues
  MOD_RES (15)..(15): Alpha-Me S5-pentenyl-alanine olefin amino acid connected by an all-carbon crosslinker comprising one double bond
  C-term NH2
QSQQTFSALWRLLAAN

SEQ ID NO: 816 - protein, 16 aa, Artificial Sequence
  Description of Artificial Sequence: Synthetic peptide
  N-term Ac
  MOD_RES (3)..(3): Alpha-Me R5-pentenyl-alanine olefin amino acid connected by an all-carbon crosslinker comprising one double bond
  misc_feature (3)..(7): Crosslink between residues
  MOD_RES (7)..(7): Two pentenyl-alanine olefin side chains, each of which is crosslinked to another amino acid as indicated
  misc_feature (7)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): 2-aminoisobutyric acid
  C-term NH2
QSAQTFANLWALLXQN

SEQ ID NO: 817 - protein, 16 aa, Artificial Sequence
  Description of Artificial Sequence: Synthetic peptide
  N-term Ac
  MOD_RES (1)..(1): Alpha-Me R8-octenyl-alanine olefin amino acid that is not connected by a crosslinker
  MOD_RES (8)..(8): Alpha-Me S5-pentenyl-alanine olefin amino acid that is not connected by a crosslinker
  MOD_RES (14)..(14): 2-aminoisobutyric acid
  C-term NH2
ASQQTFSALWRLLXQN

SEQ ID NO: 818 - protein, 16 aa, Artificial Sequence
  Description of Artificial Sequence: Synthetic peptide
  N-term Ac
  MOD_RES (4)..(4): Alpha-Me R8-octenyl-alanine olefin amino acid that is not connected by a crosslinker
  MOD_RES (11)..(11): Alpha-Me S5-pentenyl-alanine olefin amino acid that is not connected by a crosslinker
  MOD_RES (14)..(14): 2-aminoisobutyric acid
  C-term NH2
QSQATFSNLWALLXQN

SEQ ID NO: 819 - protein, 16 aa, Artificial Sequence
  Description of Artificial Sequence: Synthetic peptide
  N-term Ac
  MOD_RES (8)..(8): Alpha-Me R8-octenyl-alanine olefin amino acid that is not connected by a crosslinker
  MOD_RES (15)..(15): Alpha-Me S5-pentenyl-alanine olefin amino acid that is not connected by a crosslinker
  C-term NH2
QSQQTFSALWRLLAAN

SEQ ID NO: 820 - protein, 16 aa, Artificial Sequence
  Description of Artificial Sequence: Synthetic peptide
  N-term Ac
  MOD_RES (3)..(3): Alpha-Me R5-pentenyl-alanine olefin amino acid that is not connected by a crosslinker
  MOD_RES (7)..(7): Amino acid comprising two pentenyl-alanine olefin side chains that are not crosslinked
  MOD_RES (11)..(11): Alpha-Me S5-pentenyl-alanine olefin amino acid that is not connected by a crosslinker
  MOD_RES (14)..(14): 2-aminoisobutyric acid
  C-term NH2
QSAQTFANLWALLXQN

SEQ ID NO: 821 - protein, 16 aa, Artificial Sequence
  Description of Artificial Sequence: Synthetic peptide
  N-term Ac
  MOD_RES (14)..(14): 2-aminoisobutyric acid
  C-term NH2
QSQQTFSNLWRLLXQN

SEQ ID NO: 822 - protein, 16 aa, Artificial Sequence
  Description of Artificial Sequence: Synthetic peptide
  N-term acetylated with heptanoic acid
  MOD_RES (4)..(4): Alpha-Me S5-pentenyl-alanine olefin amino acid that is not connected by a crosslinker
  MOD_RES (7)..(7): Alpha-Me R8-octenyl-alanine olefin amino acid that is not connected by a crosslinker
  MOD_RES (14)..(14): Alpha-Me S5-pentenyl-alanine olefin amino acid that is not connected by a crosslinker
  C-term NH2
QSQATFANLWRLLAQN

SEQ ID NO: 823 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
ASQQTFANLRWLLAQN

SEQ ID NO: 824 - protein, 15 aa, Artificial Sequence
  Description of Artificial Sequence: Synthetic peptide
  N-term Ac
  MOD_RES (7)..(7): Alpha-Me R8-octenyl-alanine olefin amino acid that is not connected by a crosslinker
  MOD_RES (14)..(14): Alpha-Me S5-pentenyl-alanine olefin amino acid that is not connected by a crosslinker
  C-term NH2
QSQQTFANLWRLLAQ

SEQ ID NO: 825 - protein, 15 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTFANLWRLLAQ

SEQ ID NO: 826 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
AAARAAAAAARAAAAA

SEQ ID NO: 827 - protein, 13 aa, Artificial Sequence
  Description of Artificial Sequence: Synthetic peptide
  N-term Ac
  C-term NH2
LTFEHYWAQLTSA

SEQ ID NO: 828 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLASA

SEQ ID NO: 829 - protein, 16 aa, Artificial Sequence
  Description of Artificial Sequence: Synthetic peptide
  N-term Ac
  C-term NH2
ASQQTFSNLWRLLPQN

SEQ ID NO: 830 - protein, 16 aa, Artificial Sequence
  Description of Artificial Sequence: Synthetic peptide
  N-term Ac
  MOD_RES (3)..(3): Alpha-Me S5-pentenyl-alanine olefin amino acid connected by an all-carbon crosslinker comprising one double bond
  misc_feature (3)..(7): Crosslink between residues
  MOD_RES (7)..(7): Two pentenyl-alanine olefin side chains, each of which is crosslinked to another amino acid as indicated
  misc_feature (7)..(11): Crosslink between residues
  MOD_RES (11)..(11): Alpha-Me R5-pentenyl-alanine olefin amino acid connected by an all-carbon crosslinker comprising one double bond
  MOD_RES (14)..(14): 2-aminoisobutyric acid
  C-term NH2
QSAQTFANLWALLXQN

SEQ ID NO: 831 - protein, 16 aa, Artificial Sequence
  Description of Artificial Sequence: Synthetic peptide
  N-term Ac
  MOD_RES (7)..(7): 2-aminoisobutyric acid
  MOD_RES (14)..(14): 2-aminoisobutyric acid
  C-term NH2
QSQQTFXNLWRLLXQN

SEQ ID NO: 832 - protein, 16 aa, Artificial Sequence
  Description of Artificial Sequence: Synthetic peptide
  N-term Ac
  MOD_RES (7)..(7): Norleucine
  MOD_RES (14)..(14): Norleucine
  C-term NH2
QSQQTFLNLWRLLLQN

SEQ ID NO: 833 - protein, 16 aa, Artificial Sequence
  Description of Artificial Sequence: Synthetic peptide
  N-term Ac
  MOD_RES (7)..(7): Alpha-Me R8-octenyl-alanine olefin amino acid that is not connected by a crosslinker
  MOD_RES (14)..(14): 2-aminoisobutyric acid
  C-term NH2
QSQQTFANLWRLLXQN

SEQ ID NO: 834 - protein, 16 aa, Artificial Sequence
  Description of Artificial Sequence: Synthetic peptide
  N-term Ac
  MOD_RES (7)..(7): Alpha-Me R8-octenyl-alanine olefin amino acid that is not connected by a crosslinker
  MOD_RES (14)..(14): Norleucine
  C-term NH2
QSQQTFANLWRLLLQN

SEQ ID NO: 835 - protein, 16 aa, Artificial Sequence
  Description of Artificial Sequence: Synthetic peptide
  N-term Ac
  MOD_RES (7)..(7): 2-aminoisobutyric acid
  MOD_RES (14)..(14): Alpha-Me S5-pentenyl-alanine olefin amino acid that is not connected by a crosslinker
  C-term NH2
QSQQTFXNLWRLLAQN

SEQ ID NO: 836 - protein, 16 aa, Artificial Sequence
  Description of Artificial Sequence: Synthetic peptide
  N-term Ac
  MOD_RES (7)..(7): Norleucine
  MOD_RES (14)..(14): Alpha-Me S5-pentenyl-alanine olefin amino acid that is not connected by a crosslinker
  C-term NH2
QSQQTFLNLWRLLAQN

SEQ ID NO: 837 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising no double bonds
  misc_feature (7)..(14): Crosslink between residues
  MOD_RES (10)..(10): 6cl-Trp
  MOD_RES (12)..(12): Norleucine
  MOD_RES (14)..(14): Alpha-Me S5-pentenyl-alanine olefin amino acid connected by an all-carbon crosslinker comprising no double bonds
  C-term NH2
QSQQTFANLWRLLAQN

SEQ ID NO: 838 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising no double bonds
  misc_feature (7)..(3): Crosslink between residues
  MOD_RES (10)..(10): Me6clW
  MOD_RES (14)..(14): Alpha-Me S5-pentenyl-alanine olefin amino acid connected by an all-carbon crosslinker comprising no double bonds
  C-term NH2
QSQQTFANLWRLLAQN

SEQ ID NO: 839 - protein, 8 aa, Artificial Sequence
  Description of Artificial Sequence: Synthetic peptide
  N-term Ac
  MOD_RES (2)..(2): Norleucine
  MOD_RES (3)..(3): Alpha-Me S5-pentenyl-alanine olefin amino acid connected by an all-carbon crosslinker comprising one double bond
  misc_feature (3)..(7): Crosslink between residues
  MOD_RES (7)..(7): Alpha-Me S5-pentenyl-alanine olefin amino acid connected by an all-carbon crosslinker comprising one double bond
  C-term NH2
FLAYWEAL

SEQ ID NO: 840 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWELLAA

SEQ ID NO: 841 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWQLLAA

SEQ ID NO: 842 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
LPRFANYWELLAQN

SEQ ID NO: 843 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
LPRFADYWRLLAQN

SEQ ID NO: 844 - protein, 13 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
LPRFANYWRLLAQ

SEQ ID NO: 845 - protein, 12 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
LPRFANYWRLLA

SEQ ID NO: 846 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTFADLWRLLAQN

SEQ ID NO: 847 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTFANLWRLLAEN

SEQ ID NO: 848 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTFANLWRLLAQD

SEQ ID NO: 849 - protein, 15 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTFANLWRLLAS

SEQ ID NO: 850 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
ESQQTFANLWRLLAQN

SEQ ID NO: 851 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LTFANLWRLLAQ

SEQ ID NO: 852 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LRFANLWRLLAQ

SEQ ID NO: 853 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (12)..(12): Norleucine
  MOD_RES (14)..(14): Alpha-Me S5-pentenyl-alanine olefin amino acid connected by an all-carbon crosslinker comprising one double bond
  C-term NH2
QSQQTFANWWRLLAQN

SEQ ID NO: 854 - protein, 15 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (12)..(12): Norleucine
  MOD_RES (14)..(14): Alpha-Me S5-pentenyl-alanine olefin amino acid connected by an all-carbon crosslinker comprising one double bond
  C-term NH2
QSQQTFANLWRLLAQ

SEQ ID NO: 855 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
QTFANLWRLLAQN

SEQ ID NO: 856 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
LPRFANWWRLLAQN

SEQ ID NO: 857 - protein, 13 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
LPRFANWWRLLAA

SEQ ID NO: 858 - protein, 10 aa, Artificial Sequence
  Description of Artificial Sequence: Synthetic peptide
  N-term Ac
  C-term NH2
TSFAEYWNLL

SEQ ID NO: 859 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
QTFAHWWSQLAS

SEQ ID NO: 860 - protein, 8 aa, Artificial Sequence
  Description of Artificial Sequence: Synthetic peptide
  N-term Ac
  MOD_RES (3)..(3): Alpha-Me S5-pentenyl-alanine olefin amino acid connected by an all-carbon crosslinker comprising one double bond
  misc_feature (3)..(7): Crosslink between residues
  MOD_RES (7)..(7): Alpha-Me S5-pentenyl-alanine olefin amino acid connected by an all-carbon crosslinker comprising one double bond
  C-term NH2
FMAYWEAL

SEQ ID NO: 861 - protein, 12 aa, Artificial Sequence
  Description of Artificial Sequence: Synthetic peptide
  N-term Ac
  C-term NH2
QTFEHWWSQLLS

SEQ ID NO: 862 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (10)..(10): Alpha-Me-Trp
  MOD_RES (13)..(13): Norleucine
  MOD_RES (14)..(14): Alpha-Me S5-pentenyl-alanine olefin amino acid connected by an all-carbon crosslinker comprising one double bond
  C-term NH2
QSQQTFANLWRLLAQN

SEQ ID NO: 863 - protein, 8 aa, Artificial Sequence
  Description of Artificial Sequence: Synthetic peptide
  N-term Ac
  MOD_RES (3)..(3): 2-aminoisobutyric acid
  MOD_RES (5)..(5): 6cl-Trp
  MOD_RES (7)..(7): Ac3c
  C-term NH2
FMXYWEXL

SEQ ID NO: 864 - protein, 8 aa, Artificial Sequence
  Description of Artificial Sequence: Synthetic peptide
  N-term Ac
  MOD_RES (2)..(2): Norleucine
  MOD_RES (3)..(3): Alpha-Me S5-pentenyl-alanine olefin amino acid connected by an all-carbon crosslinker comprising one double bond
  misc_feature (3)..(7): Crosslink between residues
  MOD_RES (5)..(5): 6cl-Trp
  MOD_RES (7)..(7): Alpha-Me S5-pentenyl-alanine olefin amino acid connected by an all-carbon crosslinker comprising one double bond
  C-term NH2
FLAYWEAL

SEQ ID NO: 865 - protein, 9 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one Z configured double bond
  misc_feature (2)..(9): Crosslink between residues
  MOD_RES (5)..(5): 6cl-Trp
  MOD_RES (7)..(7): Ac3c
  MOD_RES (9)..(9): Alpha-Me S5-pentenyl-alanine olefin amino acid connected by an all-carbon crosslinker comprising one Z configured double bond
  C-term NH2
FAAYWEXLA

SEQ ID NO: 866 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): 6cl-Trp
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAA

SEQ ID NO: 867 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (8)..(8): 6cl-Trp
  MOD_RES (12)..(12): Alpha-Me S5-pentenyl-alanine olefin amino acid connected by an all-carbon crosslinker comprising one double bond
  C-term NH2
LPRFANYWRLLAQN

SEQ ID NO: 868 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
AFAAAWALAAA

SEQ ID NO: 869 - protein, 11 aa, Artificial Sequence
  Description of Artificial Sequence: Synthetic peptide
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
TFAAAWRLAAQ

SEQ ID NO: 870 - protein, 11 aa, Artificial Sequence
  Description of Artificial Sequence: Synthetic peptide
  N-term Pr
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
TFAAAWRLAAQ

SEQ ID NO: 871 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising no double bonds
  misc_feature (7)..(14): Crosslink between residues
  MOD_RES (12)..(12): Norleucine
  MOD_RES (14)..(14): Alpha-Me S5-pentenyl-alanine olefin amino acid connected by an all-carbon crosslinker comprising no double bonds
  C-term NH2
QSQQTFANLWRLLAQN

SEQ ID NO: 872 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (11)..(11): Alpha-Me S5-pentenyl-alanine olefin amino acid connected by an all-carbon crosslinker comprising no double bonds
  C-term NH2
LTFAHYWAQLASA

SEQ ID NO: 873 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising no double bonds
  misc_feature (5)..(12): Crosslink between residues
  MOD_RES (12)..(12): Alpha-Me S5-pentenyl-alanine olefin amino acid connected by an all-carbon crosslinker comprising no double bonds
  C-term NH2
LPRFANYWRLLAQN

SEQ ID NO: 874 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising no double bonds
  misc_feature (5)..(12): Crosslink between residues
  MOD_RES (8)..(8): 6cl-Trp
  MOD_RES (12)..(12): Alpha-Me S5-pentenyl-alanine olefin amino acid connected by an all-carbon crosslinker comprising no double bonds
  C-term NH2
LPRFANYWRLLAQN

SEQ ID NO: 875 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (7)..(7): 6cl-Trp
  MOD_RES (11)..(11): Alpha-Me S5-pentenyl-alanine olefin amino acid connected by an all-carbon crosslinker comprising no double bonds
  C-term NH2
LTFAHYWAQLAS

SEQ ID NO: 876 - protein, 16 aa, Artificial Sequence
  Description of Artificial Sequence: Synthetic peptide
  N-term Ac
  MOD_RES (3)..(3): Alpha-Me S5-pentenyl-alanine olefin amino acid connected by an all-carbon crosslinker comprising no double bonds
  misc_feature (3)..(7): Crosslink between residues
  MOD_RES (7)..(7): Amino acid comprising two pentenyl-alanine olefin side chains, each of which is crosslinked to another amino acid as indicated via fully saturated hydrocarbon crosslinks
  misc_feature (7)..(14): Crosslink between residues
  MOD_RES (14)..(14): Alpha-Me R8-octenyl-alanine olefin amino acid connected by an all carbon crosslinker comprising no double bonds
  C-term NH2
QSAQTFANLWRLLAQN

SEQ ID NO: 877 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (7)..(7): 6cl-Trp
  MOD_RES (11)..(11): Alpha-Me S5-pentenyl-alanine olefin amino acid connected by an all-carbon crosslinker comprising no double bonds
  C-term NH2
LTFAHYWRQLAS

SEQ ID NO: 878 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising no double bonds
  misc_feature (7)..(14): Crosslink between residues
  MOD_RES (10)..(10): 6cl-Trp
  MOD_RES (14)..(14): Alpha-Me S5-pentenyl-alanine olefin amino acid connected by an all-carbon crosslinker comprising no double bonds
  C-term NH2
QSQQTFANLWRLLAQN

SEQ ID NO: 879 - protein, 16 aa, Artificial Sequence
  Description of Artificial Sequence: Synthetic peptide
  N-term Ac
  MOD_RES (1)..(1): Alpha-Me R8-octenyl-alanine olefin amino acid connected by an all-carbon crosslinker comprising no double bonds
  misc_feature (1)..(8): Crosslink between residues
  MOD_RES (8)..(8): Alpha-Me S5-pentenyl-alanine olefin amino acid connected by an all-carbon crosslinker comprising no double bonds
  MOD_RES (14)..(14): 2-aminoisobutyric acid
  C-term NH2
ASQQTFSALWRLLXQN

SEQ ID NO: 880 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (11)..(11): Alpha-Me S5-pentenyl-alanine olefin amino acid connected by an all-carbon crosslinker comprising no double bonds
  C-term NH2
LTFAHYWAQLAS

SEQ ID NO: 881 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (11)..(11): Alpha-Me S5-pentenyl-alanine olefin amino acid connected by an all-carbon crosslinker comprising no double bonds
  C-term NH2
TSFAQYWNLLAP

SEQ ID NO: 882 - protein, 12 aa, Artificial Sequence
  Description of Artificial Sequence: Synthetic peptide
  N-term Ac
  C-term NH2
LTFEHYWAQLTS

SEQ ID NO: 883 - protein, 9 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one E configured double bond
  misc_feature (2)..(9): Crosslink between residues
  MOD_RES (5)..(5): 6cl-Trp
  MOD_RES (7)..(7): Ac3c
  MOD_RES (9)..(9): Alpha-Me S5-pentenyl-alanine olefin amino acid connected by an all-carbon crosslinker comprising one E configured double bond
  C-term NH2
FAAYWEXLA

SEQ ID NO: 884 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
AFAAAWALAAA

SEQ ID NO: 885 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
TFAAAWRLAAQ

SEQ ID NO: 886 - protein, 11 aa, Artificial Sequence
  Description of Artificial Sequence: Synthetic peptide
  N-term Pr
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
TFAAAWRLAAQ

SEQ ID NO: 887 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one E configured double bond
  misc_feature (4)..(11): Crosslink between residues
  MOD_RES (11)..(11): Alpha-Me S5-pentenyl-alanine olefin amino acid connected by an all-carbon crosslinker comprising one E configured double bond
  C-term NH2
LTFAHYWAQLAS

SEQ ID NO: 888 - protein, 23 aa, Artificial Sequence
  Description of Artificial Sequence: Synthetic peptide
  N-term Ac
  MOD_RES (7)..(7): Beta-Ala
  MOD_RES (14)..(14): Alpha-Me R8-octenyl-alanine olefin amino acid connected by an all-carbon crosslinker comprising one double bond
  misc_feature (14)..(21): Crosslink between residues
  MOD_RES (21)..(21): Alpha-Me S5-pentenyl-alanine olefin amino acid connected by an all-carbon crosslinker comprising one double bond
  C-term NH2
CCPGCCAQSQQTFANLWRLLAQN

SEQ ID NO: 889 - protein, 23 aa, Artificial Sequence
  Description of Artificial Sequence: Synthetic peptide
  N-term Ac
  MOD_RES (7)..(7): Beta-Ala
  MOD_RES (14)..(14): Alpha-Me R8-octenyl-alanine olefin amino acid connected by an all-carbon crosslinker comprising one double bond
  misc_feature (14)..(21): Crosslink between residues
  MOD_RES (21)..(21): Alpha-Me S5-pentenyl-alanine olefin amino acid connected by an all-carbon crosslinker comprising one double bond
  C-term NH2
CCPGCCAQSQQTAANLWRLLAQN

SEQ ID NO: 890 - protein, 21 aa, Artificial Sequence
  Description of Artificial Sequence: Synthetic peptide
  N-term Ac
  MOD_RES (7)..(7): Beta-Ala
  MOD_RES (8)..(8): Norleucine
  MOD_RES (12)..(12): Alpha-Me R8-octenyl-alanine olefin amino acid connected by an all-carbon crosslinker comprising one double bond
  misc_feature (12)..(19): Crosslink between residues
  MOD_RES (19)..(19): Alpha-Me S5-pentenyl-alanine olefin amino acid connected by an all-carbon crosslinker comprising one double bond
  C-term NH2
CCPGCCALPRFANYWRLLAQN

SEQ ID NO: 891 - protein, 12 aa, Artificial Sequence
  Description of Artificial Sequence: Synthetic peptide
  N-term Ac
  MOD_RES (4)..(4): Alpha-Me R8-octenyl-alanine olefin amino acid that is not connected by a crosslinker
  MOD_RES (11)..(11): Alpha-Me S5-pentenyl-alanine olefin amino acid that is not connected by a crosslinker
  C-term NH2
LTFAHYWAQLAS

SEQ ID NO: 892 - protein, 9 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising no double bonds
  misc_feature (2)..(9): Crosslink between residues
  MOD_RES (5)..(5): 6cl-Trp
  MOD_RES (7)..(7): Ac3c
  MOD_RES (9)..(9): Alpha-Me S5-pentenyl-alanine olefin amino acid connected by an all-carbon crosslinker comprising no double bonds
  C-term NH2
FAHYWRXLA

SEQ ID NO: 893 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (11)..(11): Alpha-Me S5-pentenyl-alanine olefin amino acid connected by an all-carbon crosslinker comprising no double bonds
  C-term NH2
QTFAHWWSQLAS

SEQ ID NO: 894 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYWRQLAS

SEQ ID NO: 895 - protein, 16 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (14)..(14): 2-aminoisobutyric acid
  C-term NH2
QAQQTFSNAWRLLXQN

SEQ ID NO: 896 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (14)..(14): 2-aminoisobutyric acid
  C-term NH2
QSQQAFSNLWRALXQN

SEQ ID NO: 897 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAA

SEQ ID NO: 898 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAS

SEQ ID NO: 899 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAQ

SEQ ID NO: 900 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): 2-aminoisobutyric acid
  MOD_RES (9)..(9): Alpha-Me S5-pentenyl-alanine olefin amino acid connected by an all-carbon crosslinker comprising one double bond
  C-term NH2
FAAYWEXLAS

SEQ ID NO: 901 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEALAS

SEQ ID NO: 902 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEQLAS

SEQ ID NO: 903 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAHYWEQLAS

SEQ ID NO: 904 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAHYWAQLAS

SEQ ID NO: 905 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAHYWAXLAS

SEQ ID NO: 906 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAHYWRXLAS

SEQ ID NO: 907 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-hydrogen S5-pentenyl-alanine olefin amino acid connected by an all-carbon crosslinker comprising one double bond
  C-term NH2
FAAYWEXLAA

SEQ ID NO: 908 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising no double bonds
  misc_feature (5)..(3): Crosslink between residues
  MOD_RES (12)..(12): Alpha-Me S5-pentenyl-alanine olefin amino acid connected by an all-carbon crosslinker comprising no double bonds
  C-term NH2
LPTFANYWRLLAQN

SEQ ID NO: 909 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
TFAAAWRALAQ

SEQ ID NO: 910 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (11)..(11): Alpha-Me S5-pentenyl-alanine olefin amino acid connected by an all-carbon crosslinker comprising no double bonds
  C-term NH2
TSFAHYWAQLAS

SEQ ID NO: 911 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising no double bonds
  misc_feature (2)..(9): Crosslink between residues
  MOD_RES (5)..(5): 6cl-Trp
  MOD_RES (7)..(7): Ac3c
  MOD_RES (9)..(9): Alpha-Me S5-pentenyl-alanine olefin amino acid connected by an all-carbon crosslinker comprising no double bonds
  C-term NH2
FAAYWEXLAA

SEQ ID NO: 912 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQIAS

SEQ ID NO: 913 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Norleucine
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 914 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAA

SEQ ID NO: 915 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (12)..(12): Abu
  C-term NH2
LTFAHYWAQLAX

SEQ ID NO: 916 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Abu
  MOD_RES (11)..(11): Alpha-Me S5-pentenyl-alanine olefin amino acid connected by an all-carbon crosslinker comprising one double bond
  C-term NH2
LTFAHYWXQLAS

SEQ ID NO: 917 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one E configured double bond
  misc_feature (4)..(11): Crosslink between residues
  MOD_RES (11)..(11): Alpha-Me S5-pentenyl-alanine olefin amino acid connected by an all-carbon crosslinker comprising one E configured double bond
  C-term NH2
LTFAAYWAQLAS

SEQ ID NO: 918 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LAFAHYWAQLAS

SEQ ID NO: 919 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LAFAAYWAQLAS

SEQ ID NO: 920 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one E configured double bond
  misc_feature (4)..(11): Crosslink between residues
  MOD_RES (11)..(11): Alpha-Me S5-pentenyl-alanine olefin amino acid connected by an all-carbon crosslinker comprising one E configured double bond
  C-term NH2
LTFAAYWAQLAA

SEQ ID NO: 921 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LAFAAYWAQLAA

SEQ ID NO: 922 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LTFANLWALLAQ

SEQ ID NO: 923 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LTFANLWALLAA

SEQ ID NO: 924 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LTFAALWALLAQ

SEQ ID NO: 925 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LAFANLWALLAQ

SEQ ID NO: 926 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LAFAALWALLAA

SEQ ID NO: 927 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
AAAYWEXLAA

SEQ ID NO: 928 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAA

SEQ ID NO: 929 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (10)..(10): Abu
  C-term NH2
FAAYWEXLAX

SEQ ID NO: 930 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (10)..(10): Norleucine
  C-term NH2
FAAYWEXLAL

SEQ ID NO: 931 - protein, 10 aa, Artificial Sequence
  Description of Artificial Sequence: Synthetic peptide
  N-term Ac
  MOD_RES (2)..(2): Alpha-Me R5-pentenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S8-octenyl-alanine olefin amino acid connected by an all-carbon crosslinker comprising one double bond
  C-term NH2
FAAYWEXLAA

SEQ ID NO: 932 - protein, 10 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me R8-octenyl-alanine olefin amino acid connected by an all-carbon crosslinker comprising one double bond
  C-term NH2
FAAYWEXLAA

SEQ ID NO: 933 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXIAA

SEQ ID NO: 934 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (8)..(8): Norleucine
  MOD_RES (9)..(9): Alpha-Me S5-pentenyl-alanine olefin amino acid connected by an all-carbon crosslinker comprising one double bond
  C-term NH2
FAAYWEXLAA

SEQ ID NO: 935 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Alpha-Me-Leu
  MOD_RES (9)..(9): Alpha-Me S5-pentenyl-alanine olefin amino acid connected by an all-carbon crosslinker comprising one double bond
  C-term NH2
FAAYWELLAA

SEQ ID NO: 936 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Norleucine
  MOD_RES (9)..(9): Alpha-Me S5-pentenyl-alanine olefin amino acid connected by an all-carbon crosslinker comprising one double bond
  C-term NH2
FAAYWELLAA

SEQ ID NO: 937 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWQXLAA

SEQ ID NO: 938 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWAXLAA

SEQ ID NO: 939 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (6)..(6): Abu
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWXXLAA

SEQ ID NO: 940 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (6)..(6): Norleucine
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWLXLAA

SEQ ID NO: 941 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (3)..(3): Abu
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAXYWEXLAA

SEQ ID NO: 942 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (3)..(3): Norleucine
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FALYWEXLAA

SEQ ID NO: 943 - protein, 13 aa, Artificial Sequence
  Description of Artificial Sequence: Synthetic peptide
  N-term 5-FAM
  MOD_RES (1)..(1): Beta-Ala
  C-term NH2
ALTFEHYWAQLTS

SEQ ID NO: 944 - protein, 13 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising no double bonds
  misc_feature (5)..(12): Crosslink between residues
  MOD_RES (12)..(12): Alpha-Me S5-pentenyl-alanine olefin amino acid connected by an all-carbon crosslinker comprising no double bonds
  C-term NH2
ALTFAHYWAQLAS

SEQ ID NO: 945 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 946 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Tert-butyl-Gly
  MOD_RES (11)..(11): Alpha-Me S5-pentenyl-alanine olefin amino acid connected by an all-carbon crosslinker comprising one double bond
  C-term NH2
LTFAHYWAQGAS

SEQ ID NO: 947 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Adamantyl-Gly
  MOD_RES (11)..(11): Alpha-Me S5-pentenyl-alanine olefin amino acid connected by an all-carbon crosslinker comprising one double bond
  C-term NH2
LTFAHYWAQGAS

SEQ ID NO: 948 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): homo-cyclohexyl-Ala
  MOD_RES (11)..(11): Alpha-Me S5-pentenyl-alanine olefin amino acid connected by an all-carbon crosslinker comprising one double bond
  C-term NH2
LTFAHYWAQAAS

SEQ ID NO: 949 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Ala
  MOD_RES (11)..(11): Alpha-Me S5-pentenyl-alanine olefin amino acid connected by an all-carbon crosslinker comprising one double bond
  C-term NH2
LTFAHYWAQAAS

SEQ ID NO: 950 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Ac6c
  MOD_RES (11)..(11): Alpha-Me S5-pentenyl-alanine olefin amino acid connected by an all-carbon crosslinker comprising one double bond
  C-term NH2
LTFAHYWXQLAS

SEQ ID NO: 951 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Ac5c
  MOD_RES (11)..(11): Alpha-Me S5-pentenyl-alanine olefin amino acid connected by an all-carbon crosslinker comprising one double bond
  C-term NH2
LTFAHYWXQLAS

SEQ ID NO: 952 - protein, 12 aa, Artificial Sequence
  Description of Artificial Sequence: Synthetic peptide
  N-term Ac
  MOD_RES (3)..(3): homo-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 953 - protein, 12 aa, Artificial Sequence
  Description of Artificial Sequence: Synthetic peptide
  N-term Ac
  MOD_RES (3)..(3): Indanyl-Gly
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTGAHYWAQLAS

SEQ ID NO: 954 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Gly
  MOD_RES (11)..(11): Alpha-Me S5-pentenyl-alanine olefin amino acid connected by an all-carbon crosslinker comprising one double bond
  C-term NH2
LTFAHYWAQGAS

SEQ ID NO: 955 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQFAS

SEQ ID NO: 956 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Indanyl-Gly
  MOD_RES (11)..(11): Alpha-Me S5-pentenyl-alanine olefin amino acid connected by an all-carbon crosslinker comprising one double bond
  C-term NH2
LTFAHYWAQGAS

SEQ ID NO: 957 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAHYWAQAAS

SEQ ID NO: 958 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclopentyl-Gly
  MOD_RES (11)..(11): Alpha-Me S5-pentenyl-alanine olefin amino acid connected by an all-carbon crosslinker comprising one double bond
  C-term NH2
LTFAHYWAQGAS

SEQ ID NO: 959 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): hY
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 960 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (8)..(8): hLeu
  MOD_RES (9)..(9): Alpha-Me S5-pentenyl-alanine olefin amino acid connected by an all-carbon crosslinker comprising one double bond
  C-term NH2
FAAYWEXLAA

SEQ ID NO: 961 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (8)..(8): Tert-butyl-Gly
  MOD_RES (9)..(9): Alpha-Me S5-pentenyl-alanine olefin amino acid connected by an all-carbon crosslinker comprising one double bond
  C-term NH2
FAAYWEXGAA

SEQ ID NO: 962 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (8)..(8): Adamantyl-Gly
  MOD_RES (9)..(9): Alpha-Me S5-pentenyl-alanine olefin amino acid connected by an all-carbon crosslinker comprising one double bond
  C-term NH2
FAAYWEXGAA

SEQ ID NO: 963 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (8)..(8): homo-cyclohexyl-Ala
  MOD_RES (9)..(9): Alpha-Me S5-pentenyl-alanine olefin amino acid connected by an all-carbon crosslinker comprising one double bond
  C-term NH2
FAAYWEXAAA

SEQ ID NO: 964 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (8)..(8): Cyclohexyl-Ala
  MOD_RES (9)..(9): Alpha-Me S5-pentenyl-alanine olefin amino acid connected by an all-carbon crosslinker comprising one double bond
  C-term NH2
FAAYWEXAAA

SEQ ID NO: 965 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac6c
  MOD_RES (9)..(9): Alpha-Me S5-pentenyl-alanine olefin amino acid connected by an all-carbon crosslinker comprising one double bond
  C-term NH2
FAAYWEXLAA

SEQ ID NO: 966 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac5c
  MOD_RES (9)..(9): Alpha-Me S5-pentenyl-alanine olefin amino acid connected by an all-carbon crosslinker comprising one double bond
  C-term NH2
FAAYWEXLAA

SEQ ID NO: 967 - protein, 10 aa, Artificial Sequence
  Description of Artificial Sequence: Synthetic peptide
  N-term Ac
  MOD_RES (1)..(1): homo-Phe
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAA

SEQ ID NO: 968 - protein, 10 aa, Artificial Sequence
  Description of Artificial Sequence: Synthetic peptide
  N-term Ac
  MOD_RES (1)..(1): Indanyl-Gly
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
GAAYWEXLAA

SEQ ID NO: 969 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXFAA

SEQ ID NO: 970 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (8)..(8): Indanyl-Gly
  MOD_RES (9)..(9): Alpha-Me S5-pentenyl-alanine olefin amino acid connected by an all-carbon crosslinker comprising one double bond
  C-term NH2
FAAYWEXGAA

SEQ ID NO: 971 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (8)..(8): Cyclobutyl-Ala
  MOD_RES (9)..(9): Alpha-Me S5-pentenyl-alanine olefin amino acid connected by an all-carbon crosslinker comprising one double bond
  C-term NH2
FAAYWEXAAA

SEQ ID NO: 972 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (8)..(8): Cyclopentyl-Gly
  MOD_RES (9)..(9): Alpha-Me S5-pentenyl-alanine olefin amino acid connected by an all-carbon crosslinker comprising one double bond
  C-term NH2
FAAYWEXGAA

SEQ ID NO: 973 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (4)..(4): hY
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAA

SEQ ID NO: 974 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAQ

SEQ ID NO: 975 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): 2-aminoisobutyric acid
  MOD_RES (9)..(9): Alpha-Me S5-pentenyl-alanine olefin amino acid connected by an all-carbon crosslinker comprising one double bond
  C-term NH2
FAAYWEXLAA

SEQ ID NO: 976 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEALAA

SEQ ID NO: 977 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LAFAAYWAALAA

SEQ ID NO: 978 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Ac3c
  MOD_RES (11)..(11): Alpha-Me S5-pentenyl-alanine olefin amino acid connected by an all-carbon crosslinker comprising one double bond
  C-term NH2
LTFAHYWAXLAS

SEQ ID NO: 979 - protein, 12 aa, Artificial Sequence
  Description of Artificial Sequence: Synthetic peptide
  N-term Ac
  MOD_RES (1)..(1): Norleucine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 980 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
VTFAHYWAQLAS

SEQ ID NO: 981 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
FTFAHYWAQLAS

SEQ ID NO: 982 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFAHYWAQLAS

SEQ ID NO: 983 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
RTFAHYWAQLAS

SEQ ID NO: 984 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
KTFAHYWAQLAS

SEQ ID NO: 985 - protein, 12 aa, Artificial Sequence
  Description of Artificial Sequence: Synthetic peptide
  N-term Ac
  MOD_RES (2)..(2): Norleucine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LLFAHYWAQLAS

SEQ ID NO: 986 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LVFAHYWAQLAS

SEQ ID NO: 987 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LFFAHYWAQLAS

SEQ ID NO: 988 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LWFAHYWAQLAS

SEQ ID NO: 989 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LRFAHYWAQLAS

SEQ ID NO: 990 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LKFAHYWAQLAS

SEQ ID NO: 991 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): Norleucine
  MOD_RES (11)..(11): Alpha-Me S5-pentenyl-alanine olefin amino acid connected by an all-carbon crosslinker comprising one double bond
  C-term NH2
LTFALYWAQLAS

SEQ ID NO: 992 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLAS

SEQ ID NO: 993 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAFYWAQLAS

SEQ ID NO: 994 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAWYWAQLAS

SEQ ID NO: 995 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFARYWAQLAS

SEQ ID NO: 996 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAKYWAQLAS

SEQ ID NO: 997 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Norleucine
  MOD_RES (11)..(11): Alpha-Me S5-pentenyl-alanine olefin amino acid connected by an all-carbon crosslinker comprising one double bond
  C-term NH2
LTFAHLWAQLAS

SEQ ID NO: 998 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHVWAQLAS

SEQ ID NO: 999 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHFWAQLAS

SEQ ID NO: 1000 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHWWAQLAS

SEQ ID NO: 1001 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHRWAQLAS

SEQ ID NO: 1002 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHKWAQLAS

SEQ ID NO: 1003 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Norleucine
  MOD_RES (11)..(11): Alpha-Me S5-pentenyl-alanine olefin amino acid connected by an all-carbon crosslinker comprising one double bond
  C-term NH2
LTFAHYWLQLAS

SEQ ID NO: 1004 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWVQLAS

SEQ ID NO: 1005 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWFQLAS

SEQ ID NO: 1006 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWWQLAS

SEQ ID NO: 1007 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWKQLAS

SEQ ID NO: 1008 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LTFAHYWALLAS

SEQ ID NO: 1009 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAVLAS

SEQ ID NO: 1010 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAFLAS

SEQ ID NO: 1011 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAWLAS

SEQ ID NO: 1012 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWARLAS

SEQ ID NO: 1013 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (12)..(12): Norleucine
  C-term NH2
LTFAHYWAQLAL

SEQ ID NO: 1014 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAV

SEQ ID NO: 1015 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAF

SEQ ID NO: 1016 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAW

SEQ ID NO: 1017 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAR

SEQ ID NO: 1018 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAK

SEQ ID NO: 1019 - protein, 16 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (14)..(14): 2-aminoisobutyric acid
  C-term NH2
QAQQTFSNAWRLLXQN

SEQ ID NO: 1020 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (14)..(14): 2-aminoisobutyric acid
  C-term NH2
QSQQAFSNLWRALXQN

SEQ ID NO: 1021 - protein, 12 aa, Artificial Sequence
  Description of Artificial Sequence: Synthetic peptide
  N-term Ac
  MOD_RES (3)..(3): 2Pal
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYWAQLAS

SEQ ID NO: 1022 - protein, 12 aa, Artificial Sequence
  Description of Artificial Sequence: Synthetic peptide
  N-term Ac
  MOD_RES (3)..(3): 3Pal
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYWAQLAS

SEQ ID NO: 1023 - protein, 12 aa, Artificial Sequence
  Description of Artificial Sequence: Synthetic peptide
  N-term Ac
  MOD_RES (3)..(3): 4Pal
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYWAQLAS

SEQ ID NO: 1024 - protein, 12 aa, Artificial Sequence
  Description of Artificial Sequence: Synthetic peptide
  N-term Ac
  MOD_RES (3)..(3): Phe-2CF3
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1025 - protein, 12 aa, Artificial Sequence
  Description of Artificial Sequence: Synthetic peptide
  N-term Ac
  MOD_RES (3)..(3): Phe-2CN
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1026 - protein, 12 aa, Artificial Sequence
  Description of Artificial Sequence: Synthetic peptide
  N-term Ac
  MOD_RES (3)..(3): Phe-2Me
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1027 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1028 - protein, 12 aa, Artificial Sequence
  Description of Artificial Sequence: Synthetic peptide
  N-term Ac
  MOD_RES (3)..(3): D-Phe-4CF3
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1029 - protein, 12 aa, Artificial Sequence
  Description of Artificial Sequence: Synthetic peptide
  N-term Ac
  MOD_RES (3)..(3): Phe-4tBu
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1030 - protein, 12 aa, Artificial Sequence
  Description of Artificial Sequence: Synthetic peptide
  N-term Ac
  MOD_RES (3)..(3): Phe-5F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1031 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(12): Crosslink between residues
  MOD_RES (7)..(7): 3Bth
  MOD_RES (12)..(12): Alpha-Me S5-pentenyl-alanine olefin amino acid connected by an all-carbon crosslinker comprising one double bond
  C-term NH2
LTFAHYXAAQLAS

SEQ ID NO: 1032 - protein, 12 aa, Artificial Sequence
  Description of Artificial Sequence: Synthetic peptide
  N-term Ac
  MOD_RES (3)..(3): Phe-2Br
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1033 - protein, 12 aa, Artificial Sequence
  Description of Artificial Sequence: Synthetic peptide
  N-term Ac
  MOD_RES (3)..(3): Phe-4Br
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1034 - protein, 12 aa, Artificial Sequence
  Description of Artificial Sequence: Synthetic peptide
  N-term Ac
  MOD_RES (3)..(3): Phe-2Cl
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1035 - protein, 12 aa, Artificial Sequence
  Description of Artificial Sequence: Synthetic peptide
  N-term Ac
  MOD_RES (3)..(3): Phe-4Cl
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1036 - protein, 12 aa, Artificial Sequence
  Description of Artificial Sequence: Synthetic peptide
  N-term Ac
  MOD_RES (3)..(3): Phe-3CN
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1037 - protein, 12 aa, Artificial Sequence
  Description of Artificial Sequence: Synthetic peptide
  N-term Ac
  MOD_RES (3)..(3): Phe-4CN
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1038 - protein, 12 aa, Artificial Sequence
  Description of Artificial Sequence: Synthetic peptide
  N-term Ac
  MOD_RES (3)..(3): Phe-34Cl2
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1039 - protein, 12 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1040 - protein, 12 aa, Artificial Sequence
  Description of Artificial Sequence: Synthetic peptide
  N-term Ac
  MOD_RES (3)..(3): 3,5-difluoro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1041 - protein, 12 aa, Artificial Sequence
  Description of Artificial Sequence: Synthetic peptide
  N-term Ac
  MOD_RES (3)..(3): 3,3-di-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1042 - protein, 12 aa, Artificial Sequence
  Description of Artificial Sequence: Synthetic peptide
  N-term Ac
  MOD_RES (3)..(3): 2-Fluoro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1043 - protein, 12 aa, Artificial Sequence
  Description of Artificial Sequence: Synthetic peptide
  N-term Ac
  MOD_RES (3)..(3): 3-fluoro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1044 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1045 - protein, 12 aa, Artificial Sequence
  Description of Artificial Sequence: Synthetic peptide
  N-term Ac
  MOD_RES (3)..(3): 4-iodo-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1046 - protein, 12 aa, Artificial Sequence
  Description of Artificial Sequence: Synthetic peptide
  N-term Ac
  MOD_RES (3)..(3): Phe-3Me
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1047 - protein, 12 aa, Artificial Sequence
  Description of Artificial Sequence: Synthetic peptide
  N-term Ac
  MOD_RES (3)..(3): Phe-4Me
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1048 - protein, 12 aa, Artificial Sequence
  Description of Artificial Sequence: Synthetic peptide
  N-term Ac
  MOD_RES (3)..(3): 1-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYWAQLAS

SEQ ID NO: 1049 - protein, 12 aa, Artificial Sequence
  Description of Artificial Sequence: Synthetic peptide
  N-term Ac
  MOD_RES (3)..(3): 2-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYWAQLAS

SEQ ID NO: 1050 - protein, 12 aa, Artificial Sequence
  Description of Artificial Sequence: Synthetic peptide
  N-term Ac
  MOD_RES (3)..(3): Phe-3CF3
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1051 - protein, 12 aa, Artificial Sequence
  Description of Artificial Sequence: Synthetic peptide
  N-term Ac
  MOD_RES (3)..(3): Phe-4NO2
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1052 - protein, 12 aa, Artificial Sequence
  Description of Artificial Sequence: Synthetic peptide
  N-term Ac
  MOD_RES (3)..(3): Phe-3NO2
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1053 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): 2Thi
  MOD_RES (11)..(11): Alpha-Me S5-pentenyl-alanine olefin amino acid connected by an all-carbon crosslinker comprising one double bond
  C-term NH2
LTFAXYWAQLAS

SEQ ID NO: 1054 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Bi-Phe
  MOD_RES (11)..(11): Alpha-Me S5-pentenyl-alanine olefin amino acid connected by an all-carbon crosslinker comprising one double bond
  C-term NH2
LTFAHFWAQLAS

SEQ ID NO: 1055 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Phe-4tBu
  MOD_RES (11)..(11): Alpha-Me S5-pentenyl-alanine olefin amino acid connected by an all-carbon crosslinker comprising one double bond
  C-term NH2
LTFAHFWAQLAS

SEQ ID NO: 1056 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): D-Phe-4CF3
  MOD_RES (11)..(11): Alpha-Me S5-pentenyl-alanine olefin amino acid connected by an all-carbon crosslinker comprising one double bond
  C-term NH2
LTFAHFWAQLAS

SEQ ID NO: 1057 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Phe-4Cl
  MOD_RES (11)..(11): Alpha-Me S5-pentenyl-alanine olefin amino acid connected by an all-carbon crosslinker comprising one double bond
  C-term NH2
LTFAHFWAQLAS

SEQ ID NO: 1058 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Phe-4Me
  MOD_RES (11)..(11): Alpha-Me S5-pentenyl-alanine olefin amino acid connected by an all-carbon crosslinker comprising one double bond
  C-term NH2
LTFAHFWAQLAS

SEQ ID NO: 1059 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Phe-4Br
  MOD_RES (11)..(11): Alpha-Me S5-pentenyl-alanine olefin amino acid connected by an all-carbon crosslinker comprising one double bond
  C-term NH2
LTFAHFWAQLAS

SEQ ID NO: 1060 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Phe-4CN
  MOD_RES (11)..(11): Alpha-Me S5-pentenyl-alanine olefin amino acid connected by an all-carbon crosslinker comprising one double bond
  C-term NH2
LTFAHFWAQLAS

SEQ ID NO: 1061 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Phe-4NO2
  MOD_RES (11)..(11): Alpha-Me S5-pentenyl-alanine olefin amino acid connected by an all-carbon crosslinker comprising one double bond
  C-term NH2
LTFAHFWAQLAS

SEQ ID NO: 1062 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 1-Naphthalanine
  MOD_RES (11)..(11): Alpha-Me S5-pentenyl-alanine olefin amino acid connected by an all-carbon crosslinker comprising one double bond
  C-term NH2
LTFAHAWAQLAS

SEQ ID NO: 1063 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 2-Naphthalanine
  MOD_RES (11)..(11): Alpha-Me S5-pentenyl-alanine olefin amino acid connected by an all-carbon crosslinker comprising one double bond
  C-term NH2
LTFAHAWAQLAS

SEQ ID NO: 1064 - protein, 11 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(10): Crosslink between residues
  MOD_RES (10)..(10): Alpha-Me S5-pentenyl-alanine olefin amino acid connected by an all-carbon crosslinker comprising one double bond
  C-term NH2
LTFAHWAQLAS

SEQ ID NO: 1065 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 1-Naphthalanine
  MOD_RES (11)..(11): Alpha-Me S5-pentenyl-alanine olefin amino acid connected by an all-carbon crosslinker comprising one double bond
  C-term NH2
LTFAHYAAQLAS

SEQ ID NO: 1066 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 2-Naphthalanine
  MOD_RES (11)..(11): Alpha-Me S5-pentenyl-alanine olefin amino acid connected by an all-carbon crosslinker comprising one double bond
  C-term NH2
LTFAHYAAQLAS

SEQ ID NO: 1067 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQIAS

SEQ ID NO: 1068 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Norleucine
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1069 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one E configured double bond
  misc_feature (4)..(11): Crosslink between residues
  MOD_RES (11)..(11): Alpha-Me S5-pentenyl-alanine olefin amino acid connected by an all-carbon crosslinker comprising one E configured double bond
  C-term NH2
LTFAHYWAQLAA

SEQ ID NO: 1070 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (12)..(12): Abu
  C-term NH2
LTFAHYWAQLAX

SEQ ID NO: 1071 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Abu
  MOD_RES (11)..(11): Alpha-Me S5-pentenyl-alanine olefin amino acid connected by an all-carbon crosslinker comprising one double bond
  C-term NH2
LTFAHYWXQLAS

SEQ ID NO: 1072 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LAFAHYWAQLAS

SEQ ID NO: 1073 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LTFANLWALLAQ

SEQ ID NO: 1074 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LTFAALWALLAQ

SEQ ID NO: 1075 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LAFANLWALLAQ

SEQ ID NO: 1076 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWAXLAA

SEQ ID NO: 1077 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAALAS

SEQ ID NO: 1078 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LVFAAYWAQLAS

SEQ ID NO: 1079 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Abu
  MOD_RES (11)..(11): Alpha-Me S5-pentenyl-alanine olefin amino acid connected by an all-carbon crosslinker comprising one double bond
  C-term NH2
LTFAAYWXQLAS

SEQ ID NO: 1080 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Norleucine
  MOD_RES (11)..(11): Alpha-Me S5-pentenyl-alanine olefin amino acid connected by an all-carbon crosslinker comprising one double bond
  C-term NH2
LTFAAYWLQLAS

SEQ ID NO: 1081 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): Abu
  MOD_RES (11)..(11): Alpha-Me S5-pentenyl-alanine olefin amino acid connected by an all-carbon crosslinker comprising one double bond
  C-term NH2
LTFAXYWAQLAS

SEQ ID NO: 1082 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWHQLAS

SEQ ID NO: 1083 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWKQLAS

SEQ ID NO: 1084 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Ornithine
  MOD_RES (11)..(11): Alpha-Me S5-pentenyl-alanine olefin amino acid connected by an all-carbon crosslinker comprising one double bond
  C-term NH2
LTFAAYWXQLAS

SEQ ID NO: 1085 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWRQLAS

SEQ ID NO: 1086 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWSQLAS

SEQ ID NO: 1087 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWRALAS

SEQ ID NO: 1088 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWRQLAA

SEQ ID NO: 1089 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWRALAA

SEQ ID NO: 1090 - protein, 12 aa, Artificial Sequence
  Description of Artificial Sequence: Synthetic peptide
  N-term Ac
  MOD_RES (4)..(4): Alpha-Me R5-pentenyl-alanine olefin amino acid connected by an all-carbon crosslinker comprising one double bond
  misc_feature (4)..(11): Crosslink between residues
  MOD_RES (11)..(11): Alpha-Me S8-octenyl-alanine olefin amino acid connected by an all-carbon crosslinker comprising one double bond
  C-term NH2
LTFAHYWAQLAS

SEQ ID NO: 1091 - protein, 12 aa, Artificial Sequence
  Description of Artificial Sequence: Synthetic peptide
  N-term Ac
  MOD_RES (4)..(4): Alpha-Me S5-pentenyl-alanine olefin amino acid connected by an all-carbon crosslinker comprising one double bond
  misc_feature (4)..(11): Crosslink between residues
  MOD_RES (11)..(11): Alpha-Me R8-octenyl-alanine olefin amino acid connected by an all-carbon crosslinker comprising one double bond
  C-term NH2
LTFAHYWAQLAS

SEQ ID NO: 1092 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAALAS

SEQ ID NO: 1093 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Abu
  MOD_RES (11)..(11): Alpha-Me S5-pentenyl-alanine olefin amino acid connected by an all-carbon crosslinker comprising one double bond
  C-term NH2
LTFAHYWAXLAS

SEQ ID NO: 1094 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWALLAS

SEQ ID NO: 1095 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWHALAA

SEQ ID NO: 1096 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWAALAA

SEQ ID NO: 1097 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWSALAA

SEQ ID NO: 1098 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWRALAA

SEQ ID NO: 1099 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWKALAA

SEQ ID NO: 1100 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (6)..(6): Ornithine
  MOD_RES (9)..(9): Alpha-Me S5-pentenyl-alanine olefin amino acid connected by an all-carbon crosslinker comprising one double bond
  C-term NH2
FAAYWXALAA

SEQ ID NO: 1101 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAVYWEXLAA

SEQ ID NO: 1102 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAFYWEXLAA

SEQ ID NO: 1103 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAWYWEXLAA

SEQ ID NO: 1104 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FARYWEXLAA

SEQ ID NO: 1105 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAKYWEXLAA

SEQ ID NO: 1106 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (4)..(4): Norleucine
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAALWEXLAA

SEQ ID NO: 1107 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAVWEXLAA

SEQ ID NO: 1108 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAFWEXLAA

SEQ ID NO: 1109 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAWWEXLAA

SEQ ID NO: 1110 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAARWEXLAA

SEQ ID NO: 1111 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAKWEXLAA

SEQ ID NO: 1112 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWVXLAA

SEQ ID NO: 1113 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWFXLAA

SEQ ID NO: 1114 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWWXLAA

SEQ ID NO: 1115 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWRXLAA

SEQ ID NO: 1116 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWKXLAA

SEQ ID NO: 1117 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEVLAA

SEQ ID NO: 1118 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEFLAA

SEQ ID NO: 1119 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEWLAA

SEQ ID NO: 1120 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWERLAA

SEQ ID NO: 1121 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEKLAA

SEQ ID NO: 1122 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAV

SEQ ID NO: 1123 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAF

SEQ ID NO: 1124 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAW

SEQ ID NO: 1125 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAR

SEQ ID NO: 1126 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAK

SEQ ID NO: 1127 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAV

SEQ ID NO: 1128 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAF

SEQ ID NO: 1129 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAW

SEQ ID NO: 1130 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAR

SEQ ID NO: 1131 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAK

SEQ ID NO: 1132 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAH

SEQ ID NO: 1133 - protein, 12 aa, Artificial Sequence
  Description of Artificial Sequence: Synthetic peptide
  N-term Ac
  MOD_RES (3)..(3): Phe-2NO2
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1134 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYAAQLAS

SEQ ID NO: 1135 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYAAQLAS

SEQ ID NO: 1136 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTFANLWALLAAN

SEQ ID NO: 1137 - protein, 16 aa, Artificial Sequence
  Description of Artificial Sequence: Synthetic peptide
  N-term Ac
  MOD_RES (2)..(2): 2-aminoisobutyric acid
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QXQQTFANLWALLAAN

SEQ ID NO: 1138 - protein, 16 aa, Artificial Sequence
  Description of Artificial Sequence: Synthetic peptide
  N-term Ac
  MOD_RES (2)..(2): 2-aminoisobutyric acid
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QXQQTFAALWALLAAN

SEQ ID NO: 1139 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
AAAATFAAAWAALAAA

SEQ ID NO: 1140 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAAWRALAQ

SEQ ID NO: 1141 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
TFAAAWAALAQ

SEQ ID NO: 1142 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
TFAAAWRALAA

SEQ ID NO: 1143 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
VFAAAWRALAQ

SEQ ID NO: 1144 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
AFAAAWAALAA

SEQ ID NO: 1145 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
TFAAAWKALAQ

SEQ ID NO: 1146 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (7)..(7): Ornithine
  MOD_RES (10)..(10): Alpha-Me S5-pentenyl-alanine olefin amino acid connected by an all-carbon crosslinker comprising one double bond
  C-term NH2
TFAAAWXALAQ

SEQ ID NO: 1147 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
TFAAAWSALAQ

SEQ ID NO: 1148 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAAWRALAQ

SEQ ID NO: 1149 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWAQLAA

SEQ ID NO: 1150 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAWWAALAA

SEQ ID NO: 1151 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAWWAQLAA

SEQ ID NO: 1152 - protein, 9 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEALA

SEQ ID NO: 1153 - protein, 9 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWAALA

SEQ ID NO: 1154 - protein, 9 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWKALA

SEQ ID NO: 1155 - protein, 9 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (6)..(6): Ornithine
  MOD_RES (9)..(9): Alpha-Me S5-pentenyl-alanine olefin amino acid connected by an all-carbon crosslinker comprising one double bond
  C-term NH2
FAAYWXALA

SEQ ID NO: 1156 - protein, 9 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWQALA

SEQ ID NO: 1157 - protein, 9 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWAQLA

SEQ ID NO: 1158 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAHYWDQLAS

SEQ ID NO: 1159 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAHFWEQLAS

SEQ ID NO: 1160 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWHQLAS

SEQ ID NO: 1161 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWKQLAS

SEQ ID NO: 1162 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (6)..(6): Ornithine
  MOD_RES (9)..(9): Alpha-Me S5-pentenyl-alanine olefin amino acid connected by an all-carbon crosslinker comprising one double bond
  C-term NH2
FAAYWXQLAS

SEQ ID NO: 1163 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAHYWSQLAS

SEQ ID NO: 1164 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAHWWEQLAS

SEQ ID NO: 1165 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAHWWAQLAS

SEQ ID NO: 1166 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAWWHQLAS

SEQ ID NO: 1167 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAWWKQLAS

SEQ ID NO: 1168 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (6)..(6): Ornithine
  MOD_RES (9)..(9): Alpha-Me S5-pentenyl-alanine olefin amino acid connected by an all-carbon crosslinker comprising one double bond
  C-term NH2
FAAWWXQLAS

SEQ ID NO: 1169 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAHWWSQLAS

SEQ ID NO: 1170 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LTFANYWALLAQ

SEQ ID NO: 1171 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFANLWAQLAQ

SEQ ID NO: 1172 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LTFANYWALLAA

SEQ ID NO: 1173 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFANLWAQLAA

SEQ ID NO: 1174 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LTFAAYWALLAQ

SEQ ID NO: 1175 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAALWAQLAQ

SEQ ID NO: 1176 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LAFANYWALLAQ

SEQ ID NO: 1177 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LAFANLWAQLAQ

SEQ ID NO: 1178 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LAFAAYWALLAA

SEQ ID NO: 1179 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LAFAALWAQLAA

SEQ ID NO: 1180 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LAFAAYWAALAA

SEQ ID NO: 1181 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (11)..(11): 2-aminoisobutyric acid
  C-term NH2
FAAYWEXLAAX

SEQ ID NO: 1182 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWAQLAAA

SEQ ID NO: 1183 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWAXLAAA

SEQ ID NO: 1184 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWSXLAAA

SEQ ID NO: 1185 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAS

SEQ ID NO: 1186 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAT

SEQ ID NO: 1187 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAL

SEQ ID NO: 1188 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAQ

SEQ ID NO: 1189 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAFWEXLAAA

SEQ ID NO: 1190 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAWWEXLAAA

SEQ ID NO: 1191 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLASA

SEQ ID NO: 1192 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEALAAA

SEQ ID NO: 1193 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Norleucine
  MOD_RES (9)..(9): Alpha-Me S5-pentenyl-alanine olefin amino acid connected by an all-carbon crosslinker comprising one double bond
  C-term NH2
FAAYWELLAAA

SEQ ID NO: 1194 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (10)..(10): Abu
  C-term NH2
FAAYWEXLAXA

SEQ ID NO: 1195 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (10)..(10): Norleucine
  C-term NH2
FAAYWEXLALA

SEQ ID NO: 1196 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): 2-aminoisobutyric acid
  MOD_RES (9)..(9): Alpha-Me S5-pentenyl-alanine olefin amino acid connected by an all-carbon crosslinker comprising one double bond
  MOD_RES (10)..(10): Norleucine
  C-term NH2
FAAYWEXLALA

SEQ ID NO: 1197 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (10)..(10): Norleucine
  C-term NH2
FAAYWEALALA

SEQ ID NO: 1198 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Norleucine
  MOD_RES (9)..(9): Alpha-Me S5-pentenyl-alanine olefin amino acid connected by an all-carbon crosslinker comprising one double bond
  MOD_RES (10)..(10): Norleucine
  C-term NH2
FAAYWELLALA

SEQ ID NO: 1199 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): 2-aminoisobutyric acid
  MOD_RES (9)..(9): Alpha-Me S5-pentenyl-alanine olefin amino acid connected by an all-carbon crosslinker comprising one double bond
  MOD_RES (10)..(10): Abu
  C-term NH2
FAAYWEXLAX

SEQ ID NO: 1200 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Norleucine
  MOD_RES (9)..(9): Alpha-Me S5-pentenyl-alanine olefin amino acid connected by an all-carbon crosslinker comprising one double bond
  MOD_RES (10)..(10): Abu
  C-term NH2
FAAYWELLAX

SEQ ID NO: 1201 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (10)..(10): Abu
  C-term NH2
FAAYWEALAX

SEQ ID NO: 1202 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAFWAQLAS

SEQ ID NO: 1203 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAWWAQLAS

SEQ ID NO: 1204 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQIAS

SEQ ID NO: 1205 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Norleucine
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1206 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASA

SEQ ID NO: 1207 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAWWAQLAA

SEQ ID NO: 1208 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQIAA

SEQ ID NO: 1209 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Norleucine
  MOD_RES (11)..(11): Alpha-Me S5-pentenyl-alanine olefin amino acid connected by an all-carbon crosslinker comprising one double bond
  C-term NH2
LTFAAYWAQLAA

SEQ ID NO: 1210 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAAA

SEQ ID NO: 1211 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHWWAQLAS

SEQ ID NO: 1212 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHRWAQLAS

SEQ ID NO: 1213 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHKWAQLAS

SEQ ID NO: 1214 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAW

SEQ ID NO: 1215 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (6)..(6): Abu
  MOD_RES (9)..(9): Alpha-Me S5-pentenyl-alanine olefin amino acid connected by an all-carbon crosslinker comprising one double bond
  C-term NH2
FAAYWXALAA

SEQ ID NO: 1216 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (3)..(3): Abu
  MOD_RES (9)..(9): Alpha-Me S5-pentenyl-alanine olefin amino acid connected by an all-carbon crosslinker comprising one double bond
  C-term NH2
FAXYWEALAA

SEQ ID NO: 1217 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising no double bonds
  misc_feature (5)..(12): Crosslink between residues
  MOD_RES (12)..(12): Alpha-Me S5-pentenyl-alanine olefin amino acid connected by an all-carbon crosslinker comprising no double bonds
  C-term NH2
LPRFANYWRLLAQN

SEQ ID NO: 1218 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (11)..(11): Alpha-Me S5-pentenyl-alanine olefin amino acid connected by an all-carbon crosslinker comprising no double bonds
  C-term NH2
TSFAHYWAQLAS

SEQ ID NO: 1219 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (11)..(11): Alpha-Me S5-pentenyl-alanine olefin amino acid connected by an all-carbon crosslinker comprising no double bonds
  C-term NH2
LTFAAYWAQLAS

SEQ ID NO: 1220 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
HTFAHYWAQLAS

SEQ ID NO: 1221 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LHFAHYWAQLAS

SEQ ID NO: 1222 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHHWAQLAS

SEQ ID NO: 1223 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWHQLAS

SEQ ID NO: 1224 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAHLAS

SEQ ID NO: 1225 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAH

SEQ ID NO: 1226 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHPr
LTFAHYWAQLAS

SEQ ID NO: 1227 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHsBu
LTFAHYWAQLAS

SEQ ID NO: 1228 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHiBu
LTFAHYWAQLAS

SEQ ID NO: 1229 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHBn
LTFAHYWAQLAS

SEQ ID NO: 1230 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHPe
LTFAHYWAQLAS

SEQ ID NO: 1231 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHChx
LTFAHYWAQLAS

SEQ ID NO: 1232 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAAYWAQLAS

SEQ ID NO: 1233 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
STFAAYWAQLAS

SEQ ID NO: 1234 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LEFAAYWAQLAS

SEQ ID NO: 1235 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LSFAAYWAQLAS

SEQ ID NO: 1236 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLAS

SEQ ID NO: 1237 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFASYWAQLAS

SEQ ID NO: 1238 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWEQLAS

SEQ ID NO: 1239 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAELAS

SEQ ID NO: 1240 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWASLAS

SEQ ID NO: 1241 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAE

SEQ ID NO: 1242 - protein, 12 aa, Artificial Sequence
  Description of Artificial Sequence: Synthetic peptide
  N-term Ac
  MOD_RES (3)..(3): Phe-2CN
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1243 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1244 - protein, 12 aa, Artificial Sequence
  Description of Artificial Sequence: Synthetic peptide
  N-term Ac
  MOD_RES (3)..(3): 3,3-di-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTXAHYWAQLAS

SEQ ID NO: 1245 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Tert-butyl-Gly
  MOD_RES (11)..(11): Alpha-Me S5-pentenyl-alanine olefin amino acid connected by an all-carbon crosslinker comprising one double bond
  C-term NH2
LTFAHYWAQGAS

SEQ ID NO: 1246 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): 6cl-Trp
  MOD_RES (9)..(9): Alpha-Me S5-pentenyl-alanine olefin amino acid connected by an all-carbon crosslinker comprising one double bond
  C-term NH2
FAAYWEALAA

SEQ ID NO: 1247 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): dl6br-Trp
  MOD_RES (9)..(9): Alpha-Me S5-pentenyl-alanine olefin amino acid connected by an all-carbon crosslinker comprising one double bond
  C-term NH2
FAAYWEALAA

SEQ ID NO: 1248 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): dl6f-Trp
  MOD_RES (9)..(9): Alpha-Me S5-pentenyl-alanine olefin amino acid connected by an all-carbon crosslinker comprising one double bond
  C-term NH2
FAAYWEALAA

SEQ ID NO: 1249 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): dl4m-Trp
  MOD_RES (9)..(9): Alpha-Me S5-pentenyl-alanine olefin amino acid connected by an all-carbon crosslinker comprising one double bond
  C-term NH2
FAAYWEALAA

SEQ ID NO: 1250 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): dl5cl-Trp
  MOD_RES (9)..(9): Alpha-Me S5-pentenyl-alanine olefin amino acid connected by an all-carbon crosslinker comprising one double bond
  C-term NH2
FAAYWEALAA

SEQ ID NO: 1251 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): dl7m-Trp
  MOD_RES (9)..(9): Alpha-Me S5-pentenyl-alanine olefin amino acid connected by an all-carbon crosslinker comprising one double bond
  C-term NH2
FAAYWEALAA

SEQ ID NO: 1252 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (11)..(11): Alpha-Me S5-pentenyl-alanine olefin amino acid connected by an all-carbon crosslinker comprising no double bonds
  C-term NH2
LTFAHYWAQLAA

SEQ ID NO: 1253 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Cou
  MOD_RES (11)..(11): Alpha-Me S5-pentenyl-alanine olefin amino acid connected by an all-carbon crosslinker comprising one double bond
  C-term NH2
LTFAHXWAQLAS

SEQ ID NO: 1254 - protein, 12 aa, Artificial Sequence
  Description of Artificial Sequence: Synthetic peptide
  N-term Ac
  MOD_RES (6)..(6): Cou
  C-term NH2
LTFEHXWAQLTS

SEQ ID NO: 1255 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Cou
  MOD_RES (11)..(11): Alpha-Me S5-pentenyl-alanine olefin amino acid connected by an all-carbon crosslinker comprising one double bond
  C-term NH2
LTAAHXWAQLAS

SEQ ID NO: 1256 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (10)..(10): Abu
  C-term NH2
FAAYWEALAXA

SEQ ID NO: 1257 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEAIAAA

SEQ ID NO: 1258 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (8)..(8): Norleucine
  MOD_RES (9)..(9): Alpha-Me S5-pentenyl-alanine olefin amino acid connected by an all-carbon crosslinker comprising one double bond
  C-term NH2
FAAYWEALAAA

SEQ ID NO: 1259 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Alpha-Me-Leu
  MOD_RES (9)..(9): Alpha-Me S5-pentenyl-alanine olefin amino acid connected by an all-carbon crosslinker comprising one double bond
  C-term NH2
FAAYWELLAAA

SEQ ID NO: 1260 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWQALAAA

SEQ ID NO: 1261 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWAALAAA

SEQ ID NO: 1262 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (6)..(6): Abu
  MOD_RES (9)..(9): Alpha-Me S5-pentenyl-alanine olefin amino acid connected by an all-carbon crosslinker comprising one double bond
  C-term NH2
FAAYWXALAAA

SEQ ID NO: 1263 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (6)..(6): Norleucine
  MOD_RES (9)..(9): Alpha-Me S5-pentenyl-alanine olefin amino acid connected by an all-carbon crosslinker comprising one double bond
  C-term NH2
FAAYWLALAAA

SEQ ID NO: 1264 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (3)..(3): Abu
  MOD_RES (9)..(9): Alpha-Me S5-pentenyl-alanine olefin amino acid connected by an all-carbon crosslinker comprising one double bond
  C-term NH2
FAXYWEALAAA

SEQ ID NO: 1265 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (3)..(3): Norleucine
  MOD_RES (9)..(9): Alpha-Me S5-pentenyl-alanine olefin amino acid connected by an all-carbon crosslinker comprising one double bond
  C-term NH2
FALYWEALAAA

SEQ ID NO: 1266 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAFYWEALAAA

SEQ ID NO: 1267 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1268 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Adamantyl-Gly
  MOD_RES (11)..(11): Alpha-Me S5-pentenyl-alanine olefin amino acid connected by an all-carbon crosslinker comprising one double bond
  C-term NH2
LTFAHYWAQGAS

SEQ ID NO: 1269 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Indanyl-Gly
  MOD_RES (11)..(11): Alpha-Me S5-pentenyl-alanine olefin amino acid connected by an all-carbon crosslinker comprising one double bond
  C-term NH2
LTFAHYWAQGAS

SEQ ID NO: 1270 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWAQLAAA

SEQ ID NO: 1271 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAALWAQLAQ

SEQ ID NO: 1272 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEALAAA

SEQ ID NO: 1273 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Norleucine
  MOD_RES (9)..(9): Alpha-Me S5-pentenyl-alanine olefin amino acid connected by an all-carbon crosslinker comprising one double bond
  C-term NH2
FAAYWELLAAA

SEQ ID NO: 1274 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): 2-aminoisobutyric acid
  MOD_RES (9)..(9): Alpha-Me S5-pentenyl-alanine olefin amino acid connected by an all-carbon crosslinker comprising one double bond
  MOD_RES (10)..(10): Abu
  C-term NH2
FAAYWEXLAX

SEQ ID NO: 1275 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Norleucine
  MOD_RES (9)..(9): Alpha-Me S5-pentenyl-alanine olefin amino acid connected by an all-carbon crosslinker comprising one double bond
  MOD_RES (10)..(10): Abu
  C-term NH2
FAAYWELLAX

SEQ ID NO: 1276 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (10)..(10): Abu
  C-term NH2
FAAYWEALAX

SEQ ID NO: 1277 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (10)..(10): Abu
  C-term NH2
FAAYWEXLAXA

SEQ ID NO: 1278 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (10)..(10): Norleucine
  C-term NH2
FAAYWEXLALA

SEQ ID NO: 1279 - protein, 12 aa, Artificial Sequence
  Description of Artificial Sequence: Synthetic peptide
  N-term H
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1280 - protein, 12 aa, Artificial Sequence
  Description of Artificial Sequence: Synthetic peptide
  N-term mdPEG3
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1281 - protein, 12 aa, Artificial Sequence
  Description of Artificial Sequence: Synthetic peptide
  N-term mdPEG7
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1282 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (4)..(4): Pmp
  MOD_RES (5)..(5): Et6cl-Trp
  MOD_RES (9)..(9): Alpha-Me S5-pentenyl-alanine olefin amino acid connected by an all-carbon crosslinker comprising one double bond
  C-term NH2
FAAXWEALAA

SEQ ID NO: 1283 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1284 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAA

SEQ ID NO: 1285 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWWQLAS

SEQ ID NO: 1286 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWWQLAS

SEQ ID NO: 1287 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWWQLAS

SEQ ID NO: 1288 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWWQLAA

SEQ ID NO: 1289 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWWQLAA

SEQ ID NO: 1290 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1291 - protein, 12 aa, Artificial Sequence
  Description of Artificial Sequence: Synthetic peptide
  N-term Ac
  MOD_RES (3)..(3): 2-Fluoro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1292 - protein, 12 aa, Artificial Sequence
  Description of Artificial Sequence: Synthetic peptide
  N-term Ac
  MOD_RES (3)..(3): 3-fluoro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1293 - protein, 12 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1294 - protein, 12 aa, Artificial Sequence
  Description of Artificial Sequence: Synthetic peptide
  N-term Ac
  MOD_RES (3)..(3): 3,5-difluoro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1295 - protein, 10 aa, Artificial Sequence
  Description of Artificial Sequence: Synthetic peptide
  N-term Ac
  MOD_RES (1)..(1): 3-Chloro-Phe
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEALAA

SEQ ID NO: 1296 - protein, 11 aa, Artificial Sequence
  Description of Artificial Sequence: Synthetic peptide
  N-term Ac
  MOD_RES (1)..(1): 3-Chloro-Phe
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEALAAA

SEQ ID NO: 1297 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): 6cl-Trp
  MOD_RES (9)..(9): Alpha-Me S5-pentenyl-alanine olefin amino acid connected by an all-carbon crosslinker comprising one double bond
  C-term NH2
FAAYWEALAAA

SEQ ID NO: 1298 - protein, 9 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): 6cl-Trp
  MOD_RES (9)..(9): Alpha-Me S5-pentenyl-alanine olefin amino acid connected by an all-carbon crosslinker comprising one double bond
  C-term NH2
FAAYWEALA

SEQ ID NO: 1299 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  MOD_RES (11)..(11): Amino acid comprising two pentenyl-alanine olefin side chains that are not crosslinked
  C-term NH2
LTFAHYWAQLAS

SEQ ID NO: 1300 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHsBu
LTFAHYWAQLAS

SEQ ID NO: 1301 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
STFAAYWAQLAS

SEQ ID NO: 1302 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAELAS

SEQ ID NO: 1303 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAE

SEQ ID NO: 1304 - protein, 12 aa, Artificial Sequence
  Description of Artificial Sequence: Synthetic peptide
  N-term mdPEG3
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1305 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1306 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Ala
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1307 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Gly
  MOD_RES (11)..(11): Alpha-Me S5-pentenyl-alanine olefin amino acid connected by an all-carbon crosslinker comprising one double bond
  C-term NH2
LTFAAYWAQGAS

SEQ ID NO: 1308 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1309 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQFAS

SEQ ID NO: 1310 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1311 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Ala
  MOD_RES (11)..(11): Alpha-Me S5-pentenyl-alanine olefin amino acid connected by an all-carbon crosslinker comprising one double bond
  C-term NH2
LTFAHYWAQAAS

SEQ ID NO: 1312 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Gly
  MOD_RES (11)..(11): Alpha-Me S5-pentenyl-alanine olefin amino acid connected by an all-carbon crosslinker comprising one double bond
  C-term NH2
LTFAHYWAQGAS

SEQ ID NO: 1313 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAHYWAQAAS

SEQ ID NO: 1314 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1315 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Ala
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1316 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Gly
  MOD_RES (11)..(11): Alpha-Me S5-pentenyl-alanine olefin amino acid connected by an all-carbon crosslinker comprising one double bond
  C-term NH2
LTFAAYWAQGAS

SEQ ID NO: 1317 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1318 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1319 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Ala
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1320 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Gly
  MOD_RES (11)..(11): Alpha-Me S5-pentenyl-alanine olefin amino acid connected by an all-carbon crosslinker comprising one double bond
  C-term NH2
LTFAAYWAQGAS

SEQ ID NO: 1321 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1322 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): homo-Phe
  MOD_RES (11)..(11): Alpha-Me S5-pentenyl-alanine olefin amino acid connected by an all-carbon crosslinker comprising one double bond
  C-term NH2
LTFAAYWAQFAS

SEQ ID NO: 1323 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Phe-3CF3
  MOD_RES (11)..(11): Alpha-Me S5-pentenyl-alanine olefin amino acid connected by an all-carbon crosslinker comprising one double bond
  C-term NH2
LTFAAYWAQFAS

SEQ ID NO: 1324 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Phe-3Me
  MOD_RES (11)..(11): Alpha-Me S5-pentenyl-alanine olefin amino acid connected by an all-carbon crosslinker comprising one double bond
  C-term NH2
LTFAAYWAQFAS

SEQ ID NO: 1325 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): 1-Naphthalanine
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1326 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Bi-Phe
  MOD_RES (11)..(11): Alpha-Me S5-pentenyl-alanine olefin amino acid connected by an all-carbon crosslinker comprising one double bond
  C-term NH2
LTFAAYWAQFAS

SEQ ID NO: 1327 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAFYWAQLAA

SEQ ID NO: 1328 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHAm
LTFAHYWAQLAS

SEQ ID NO: 1329 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHiAm
LTFAHYWAQLAS

SEQ ID NO: 1330 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHnPr3Ph
LTFAHYWAQLAS

SEQ ID NO: 1331 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHnBu3,3Me
LTFAHYWAQLAS

SEQ ID NO: 1332 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHnPr
LTFAHYWAQLAS

SEQ ID NO: 1333 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHnEt2Ch
LTFAHYWAQLAS

SEQ ID NO: 1334 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHHex
LTFAHYWAQLAS

SEQ ID NO: 1335 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHmdPeg2
LTFAAYWAQLAS

SEQ ID NO: 1336 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHmdPeg2
LTFAAYWAQLAA

SEQ ID NO: 1337 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHmdPeg4
LTFAAYWAQLAA

SEQ ID NO: 1338 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): dl4m-Trp
  MOD_RES (9)..(9): Alpha-Me S5-pentenyl-alanine olefin amino acid connected by an all-carbon crosslinker comprising one double bond
  C-term NH2
FAAYWEALAA

SEQ ID NO: 1339 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): dl5cl-Trp
  MOD_RES (9)..(9): Alpha-Me S5-pentenyl-alanine olefin amino acid connected by an all-carbon crosslinker comprising one double bond
  C-term NH2
FAAYWEALAA

SEQ ID NO: 1340 - protein, 12 aa, Artificial Sequence
  Description of Artificial Sequence: Synthetic peptide
  N-term Ac
  MOD_RES (3)..(3): homo-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1341 - protein, 12 aa, Artificial Sequence
  Description of Artificial Sequence: Synthetic peptide
  N-term Ac
  MOD_RES (3)..(3): 2-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAAYWAQLAS

SEQ ID NO: 1342 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAAYWAQLAS

SEQ ID NO: 1343 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWVQLAS

SEQ ID NO: 1344 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAALAA

SEQ ID NO: 1345 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLAA

SEQ ID NO: 1346 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAIYWAQLAS

SEQ ID NO: 1347 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
FTFAVYWSQLAS

SEQ ID NO: 1348 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAFYWAQLAS

SEQ ID NO: 1349 - protein, 12 aa, Artificial Sequence
  Description of Artificial Sequence: Synthetic peptide
  N-term Ac
  MOD_RES (1)..(1): 2-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ATFAVYWSQLAS

SEQ ID NO: 1350 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFALYWSQLAS

SEQ ID NO: 1351 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
FTFAFYWAQLAS

SEQ ID NO: 1352 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFAVYWAQLAS

SEQ ID NO: 1353 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFAWYWAQLAS

SEQ ID NO: 1354 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
VTFAAYWSQLAS

SEQ ID NO: 1355 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFAFYWSQLAS

SEQ ID NO: 1356 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
FTFAIYWAQLAS

SEQ ID NO: 1357 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFAVYWSQLAS

SEQ ID NO: 1358 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
FTFALYWSQLAS

SEQ ID NO: 1359 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
YTFAFYWSQLAS

SEQ ID NO: 1360 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (11)..(11): Alpha-Me S5-pentenyl-alanine olefin amino acid connected by an all-carbon crosslinker comprising one double bond
  C-term NH2
LTFAAYWEALAA

SEQ ID NO: 1361 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (11)..(11): Alpha-Me S5-pentenyl-alanine olefin amino acid connected by an all-carbon crosslinker comprising one double bond
  C-term NH2
LTFAAYWSQLAS

SEQ ID NO: 1362 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): 6cl-Trp
  MOD_RES (9)..(9): Alpha-Me S5-pentenyl-alanine olefin amino acid connected by an all-carbon crosslinker comprising one double bond
  C-term NH2
FAAYWSALAA

SEQ ID NO: 1363 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): 6cl-Trp
  MOD_RES (9)..(9): Alpha-Me S5-pentenyl-alanine olefin amino acid connected by an all-carbon crosslinker comprising one double bond
  C-term NH2
FAAYWQALAAA

SEQ ID NO: 1364 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LHFAAYWAQLAS

SEQ ID NO: 1365 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1366 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAHWAQLAS

SEQ ID NO: 1367 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAHLAS

SEQ ID NO: 1368 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAH

SEQ ID NO: 1369 - protein, 13 aa, Artificial Sequence
  Description of Artificial Sequence: Synthetic peptide
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
HLTFAAYWAQLAA

SEQ ID NO: 1370 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
HHFAAYWAQLAS

SEQ ID NO: 1371 - protein, 14 aa, Artificial Sequence
  Description of Artificial Sequence: Synthetic peptide
  N-term Ac
  MOD_RES (1)..(1): D-amino acid
  MOD_RES (2)..(2): 2-aminoisobutyric acid
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (13)..(13): Alpha-Me S5-pentenyl-alanine olefin amino acid connected by an all-carbon crosslinker comprising one double bond
  C-term NH2
AXWTFAVYWSQLAS

SEQ ID NO: 1372 - protein, 13 aa, Artificial Sequence
  Description of Artificial Sequence: Synthetic peptide
  N-term Ac
  MOD_RES (1)..(1): 2-aminoisobutyric acid
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
XWTFAHYWAQLAS

SEQ ID NO: 1373 - protein, 14 aa, Artificial Sequence
  Description of Artificial Sequence: Synthetic peptide
  N-term Ac
  MOD_RES (1)..(1): 2-aminoisobutyric acid
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (13)..(13): Alpha-Me S5-pentenyl-alanine olefin amino acid connected by an all-carbon crosslinker comprising one double bond
  C-term NH2
XAWTFAHYWAQLAS

SEQ ID NO: 1374 - protein, 13 aa, Artificial Sequence
  Description of Artificial Sequence: Synthetic peptide
  N-term Ac
  MOD_RES (1)..(1): D-amino acid
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
FWTFAHYWAQLAS

SEQ ID NO: 1375 - protein, 14 aa, Artificial Sequence
  Description of Artificial Sequence: Synthetic peptide
  N-term Ac
  MOD_RES (1)..(1): 2-aminoisobutyric acid
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (13)..(13): Alpha-Me S5-pentenyl-alanine olefin amino acid connected by an all-carbon crosslinker comprising one double bond
  C-term NH2
XWWTFAHYWAQLAS

SEQ ID NO: 1376 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFALYWSQLAS

SEQ ID NO: 1377 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): Norleucine
  MOD_RES (11)..(11): Alpha-Me S5-pentenyl-alanine olefin amino acid connected by an all-carbon crosslinker comprising one double bond
  C-term NH2
WTFALYWSQLAS

SEQ ID NO: 1378 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (12)..(12): D-amino acid
  C-term NH2
LTFAAYWSQLAA

SEQ ID NO: 1379 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWARLAA

SEQ ID NO: 1380 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAHLAA

SEQ ID NO: 1381 - protein, 12 aa, Artificial Sequence
  Description of Artificial Sequence: Synthetic peptide
  N-term Ac
  MOD_RES (1)..(1): D-amino acid
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ATFAAYWAQLAS

SEQ ID NO: 1382 - protein, 12 aa, Artificial Sequence
  Description of Artificial Sequence: Synthetic peptide
  N-term Ac
  MOD_RES (1)..(1): 2-aminoisobutyric acid
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
XTFAAYWAQLAS

SEQ ID NO: 1383 - protein, 12 aa, Artificial Sequence
  Description of Artificial Sequence: Synthetic peptide
  N-term Ac
  MOD_RES (1)..(1): Alpha-Me-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
FTFAAYWAQLAS

SEQ ID NO: 1384 - protein, 12 aa, Artificial Sequence
  Description of Artificial Sequence: Synthetic peptide
  N-term Ac
  MOD_RES (1)..(1): Alpha-Me-Trp
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFAAYWAQLAS

SEQ ID NO: 1385 - protein, 12 aa, Artificial Sequence
  Description of Artificial Sequence: Synthetic peptide
  N-term Ac
  MOD_RES (1)..(1): N-methyl-Leu
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1386 - protein, 12 aa, Artificial Sequence
  Description of Artificial Sequence: Synthetic peptide
  N-term Ac
  MOD_RES (2)..(2): N-methyl-Thr
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1387 - protein, 12 aa, Artificial Sequence
  Description of Artificial Sequence: Synthetic peptide
  N-term Ac
  MOD_RES (2)..(2): Sarcosine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LXFAAYWAQLAS

SEQ ID NO: 1388 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LGFAAYWAQLAS

SEQ ID NO: 1389 - protein, 12 aa, Artificial Sequence
  Description of Artificial Sequence: Synthetic peptide
  N-term Ac
  MOD_RES (3)..(3): N-methyl-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1390 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
TFAAYWAQLAS

SEQ ID NO: 1391 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAAYWAQLAA

SEQ ID NO: 1392 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLAA

SEQ ID NO: 1393 - protein, 12 aa, Artificial Sequence
  Description of Artificial Sequence: Synthetic peptide
  N-term Ac
  MOD_RES (3)..(3): 2-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAAYWSQLAS

SEQ ID NO: 1394 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAALAS

SEQ ID NO: 1395 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): homo-cyclohexyl-Ala
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1396 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Gly
  MOD_RES (11)..(11): Alpha-Me S5-pentenyl-alanine olefin amino acid connected by an all-carbon crosslinker comprising one double bond
  C-term NH2
LTFAAYWAQGAS

SEQ ID NO: 1397 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1398 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Phe-3CF3
  MOD_RES (11)..(11): Alpha-Me S5-pentenyl-alanine olefin amino acid connected by an all-carbon crosslinker comprising one double bond
  C-term NH2
LTFAAYWAQFAS

SEQ ID NO: 1399 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): 1-Naphthalanine
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1400 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Bi-Phe
  MOD_RES (11)..(11): Alpha-Me S5-pentenyl-alanine olefin amino acid connected by an all-carbon crosslinker comprising one double bond
  C-term NH2
LTFAAYWAQFAS

SEQ ID NO: 1401 - protein, 12 aa, Artificial Sequence
  Description of Artificial Sequence: Synthetic peptide
  N-term Ac
  MOD_RES (3)..(3): 2-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAAYWAQLAS

SEQ ID NO: 1402 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWVQLAS

SEQ ID NO: 1403 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAWWAQLAS

SEQ ID NO: 1404 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
FTFAVYWSQLAS

SEQ ID NO: 1405 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAFYWAQLAS

SEQ ID NO: 1406 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFALYWSQLAS

SEQ ID NO: 1407 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
FTFAFYWAQLAS

SEQ ID NO: 1408 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
VTFAAYWSQLAS

SEQ ID NO: 1409 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAHWAQLAS

SEQ ID NO: 1410 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAH

SEQ ID NO: 1411 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAHLAS

SEQ ID NO: 1412 - protein, 14 aa, Artificial Sequence
  Description of Artificial Sequence: Synthetic peptide
  N-term Ac
  MOD_RES (1)..(1): D-amino acid
  MOD_RES (2)..(2): 2-aminoisobutyric acid
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (13)..(13): Alpha-Me S5-pentenyl-alanine olefin amino acid connected by an all-carbon crosslinker comprising one double bond
  C-term NH2
AXWTFAVYWSQLAS

SEQ ID NO: 1413 - protein, 13 aa, Artificial Sequence
  Description of Artificial Sequence: Synthetic peptide
  N-term Ac
  MOD_RES (1)..(1): 2-aminoisobutyric acid
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
XWTFAHYWAQLAS

SEQ ID NO: 1414 - protein, 14 aa, Artificial Sequence
  Description of Artificial Sequence: Synthetic peptide
  N-term Ac
  MOD_RES (1)..(1): 2-aminoisobutyric acid
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (13)..(13): Alpha-Me S5-pentenyl-alanine olefin amino acid connected by an all-carbon crosslinker comprising one double bond
  C-term NH2
XAWTFAHYWAQLAS

SEQ ID NO: 1415 - protein, 13 aa, Artificial Sequence
  Description of Artificial Sequence: Synthetic peptide
  N-term Ac
  MOD_RES (1)..(1): D-amino acid
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
FWTFAHYWAQLAS

SEQ ID NO: 1416 - protein, 14 aa, Artificial Sequence
  Description of Artificial Sequence: Synthetic peptide
  N-term Ac
  MOD_RES (1)..(1): 2-aminoisobutyric acid
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (13)..(13): Alpha-Me S5-pentenyl-alanine olefin amino acid connected by an all-carbon crosslinker comprising one double bond
  C-term NH2
XWWTFAHYWAQLAS

SEQ ID NO: 1417 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFALYWSQLAS

SEQ ID NO: 1418 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): Norleucine
  MOD_RES (11)..(11): Alpha-Me S5-pentenyl-alanine olefin amino acid connected by an all-carbon crosslinker comprising one double bond
  C-term NH2
WTFALYWSQLAS

SEQ ID NO: 1419 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (12)..(12): D-amino acid
  C-term NH2
LTFAAYWSQLAA

SEQ ID NO: 1420 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWARLAA

SEQ ID NO: 1421 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAHLAA

SEQ ID NO: 1422 - protein, 12 aa, Artificial Sequence
  Description of Artificial Sequence: Synthetic peptide
  N-term Ac
  MOD_RES (1)..(1): D-amino acid
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ATFAAYWAQLAS

SEQ ID NO: 1423 - protein, 12 aa, Artificial Sequence
  Description of Artificial Sequence: Synthetic peptide
  N-term Ac
  MOD_RES (1)..(1): 2-aminoisobutyric acid
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
XTFAAYWAQLAS

SEQ ID NO: 1424 - protein, 12 aa, Artificial Sequence
  Description of Artificial Sequence: Synthetic peptide
  N-term Ac
  MOD_RES (1)..(1): Alpha-Me-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
FTFAAYWAQLAS

SEQ ID NO: 1425 - protein, 12 aa, Artificial Sequence
  Description of Artificial Sequence: Synthetic peptide
  N-term Ac
  MOD_RES (1)..(1): Alpha-Me-Trp
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFAAYWAQLAS

SEQ ID NO: 1426 - protein, 12 aa, Artificial Sequence
  Description of Artificial Sequence: Synthetic peptide
  N-term Ac
  MOD_RES (1)..(1): N-methyl-Leu
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1427 - protein, 12 aa, Artificial Sequence
  Description of Artificial Sequence: Synthetic peptide
  N-term Ac
  MOD_RES (2)..(2): N-methyl-Thr
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1428 - protein, 12 aa, Artificial Sequence
  Description of Artificial Sequence: Synthetic peptide
  N-term Ac
  MOD_RES (2)..(2): Sarcosine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LXFAAYWAQLAS

SEQ ID NO: 1429 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
TFAAYWAQLAS

SEQ ID NO: 1430 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAAYWAQLAA

SEQ ID NO: 1431 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLAA

SEQ ID NO: 1432 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFAVYWSQLAS

SEQ ID NO: 1433 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
YTFAFYWSQLAS

SEQ ID NO: 1434 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): 6cl-Trp
  MOD_RES (9)..(9): Alpha-Me S5-pentenyl-alanine olefin amino acid connected by an all-carbon crosslinker comprising one double bond
  C-term NH2
FAAYWSALAA

SEQ ID NO: 1435 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAEYWVQLAS

SEQ ID NO: 1436 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAEHWAQLAA

SEQ ID NO: 1437 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAEYWAQLAS

SEQ ID NO: 1438 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAEHWVQLAA

SEQ ID NO: 1439 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAEHWAQLAS

SEQ ID NO: 1440 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1441 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1442 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Ala
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1443 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Gly
  MOD_RES (11)..(11): Alpha-Me S5-pentenyl-alanine olefin amino acid connected by an all-carbon crosslinker comprising one double bond
  C-term NH2
LTFAAYWAQGAS

SEQ ID NO: 1444 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1445 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (11)..(11): Alpha-Me S5-pentenyl-alanine olefin amino acid connected by an all-carbon crosslinker comprising one double bond
  C-term NH2
LTFAAYWSQLAS

SEQ ID NO: 1446 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1447 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAHYWAQAAS

SEQ ID NO: 1448 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1449 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Gly
  MOD_RES (11)..(11): Alpha-Me S5-pentenyl-alanine olefin amino acid connected by an all-carbon crosslinker comprising one double bond
  C-term NH2
LTFAAYWAQGAS

SEQ ID NO: 1450 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAEYWVALAS

SEQ ID NO: 1451 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAEHWAALAA

SEQ ID NO: 1452 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAEYWAALAS

SEQ ID NO: 1453 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAEHWVALAA

SEQ ID NO: 1454 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAEHWAALAS

SEQ ID NO: 1455 - protein, 12 aa, Artificial Sequence
  Description of Artificial Sequence: Synthetic peptide
  N-term Pam
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLAS

SEQ ID NO: 1456 - protein, 12 aa, Artificial Sequence
  Description of Artificial Sequence: Synthetic peptide
  N-term Pam
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAEYWAQLAS

SEQ ID NO: 1457 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWLQLAS

SEQ ID NO: 1458 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWLQLAS

SEQ ID NO: 1459 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEHWLQLAS

SEQ ID NO: 1460 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLAS

SEQ ID NO: 1461 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWSQLAS

SEQ ID NO: 1462 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAAYWAQLAS

SEQ ID NO: 1463 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLAS

SEQ ID NO: 1464 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHAm
LTFAHYWAQLAS

SEQ ID NO: 1465 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHiAm
LTFAHYWAQLAS

SEQ ID NO: 1466 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHnPr3Ph
LTFAHYWAQLAS

SEQ ID NO: 1467 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHnBu3,3Me
LTFAHYWAQLAS

SEQ ID NO: 1468 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHnBu
LTFAHYWAQLAS

SEQ ID NO: 1469 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHnPr
LTFAHYWAQLAS

SEQ ID NO: 1470 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHnEt2Ch
LTFAHYWAQLAS

SEQ ID NO: 1471 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHHex
LTFAHYWAQLAS

SEQ ID NO: 1472 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHmdPeg2
LTFAAYWAQLAS

SEQ ID NO: 1473 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHmdPeg2
LTFAAYWAQLAA

SEQ ID NO: 1474 - protein, 12 aa, Artificial Sequence
  Description of Artificial Sequence: Synthetic peptide
  N-term Ac
  MOD_RES (4)..(4): Alpha-Me R5-pentenyl-alanine olefin amino acid connected by an all-carbon crosslinker comprising one double bond
  misc_feature (4)..(11): Crosslink between residues
  MOD_RES (11)..(11): Alpha-Me S8-octenyl-alanine olefin amino acid connected by an all-carbon crosslinker comprising one double bond
  C-term NH2
LTFAAYWAALAS

SEQ ID NO: 1475 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou
  MOD_RES (11)..(11): Alpha-Me S5-pentenyl-alanine olefin amino acid connected by an all-carbon crosslinker comprising one double bond
  C-term NH2
LTFAAYWXQLAS

SEQ ID NO: 1476 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): Cou
  MOD_RES (11)..(11): Alpha-Me S5-pentenyl-alanine olefin amino acid connected by an all-carbon crosslinker comprising one double bond
  C-term NH2
LTFAXYWAQLAS

SEQ ID NO: 1477 - protein, 12 aa, Artificial Sequence
  Description of Artificial Sequence: Synthetic peptide
  N-term Ac
  MOD_RES (1)..(1): Cou
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
XTFAAYWAQLAS

SEQ ID NO: 1478 - protein, 12 aa, Artificial Sequence
  Description of Artificial Sequence: Synthetic peptide
  N-term H
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAA

SEQ ID NO: 1479 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
HHFAAYWAQLAS

SEQ ID NO: 1480 - protein, 12 aa, Artificial Sequence
  Description of Artificial Sequence: Synthetic peptide
  N-term Ac
  MOD_RES (3)..(3): 2-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAAYWSQLAS

SEQ ID NO: 1481 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Cou
  MOD_RES (11)..(11): Alpha-Me S5-pentenyl-alanine olefin amino acid connected by an all-carbon crosslinker comprising one double bond
  C-term NH2
LTFAHXWAQLAS

SEQ ID NO: 1482 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou2
  MOD_RES (11)..(11): Alpha-Me S5-pentenyl-alanine olefin amino acid connected by an all-carbon crosslinker comprising one double bond
  C-term NH2
LTFAAYWXQLAS

SEQ ID NO: 1483 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): Cou2
  MOD_RES (11)..(11): Alpha-Me S5-pentenyl-alanine olefin amino acid connected by an all-carbon crosslinker comprising one double bond
  C-term NH2
LTFAXYWAQLAS

SEQ ID NO: 1484 - protein, 12 aa, Artificial Sequence
  Description of Artificial Sequence: Synthetic peptide
  N-term Ac
  MOD_RES (1)..(1): Cou2
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
XTFAAYWAQLAS

SEQ ID NO: 1485 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Cou2
  MOD_RES (11)..(11): Alpha-Me S5-pentenyl-alanine olefin amino acid connected by an all-carbon crosslinker comprising one double bond
  C-term NH2
LTFAAXWAQLAS

SEQ ID NO: 1486 - protein, 12 aa, Artificial Sequence
  Description of Artificial Sequence: Synthetic peptide
  N-term Dmaac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1487 - protein, 12 aa, Artificial Sequence
  Description of Artificial Sequence: Synthetic peptide
  N-term Hexac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1488 - protein, 12 aa, Artificial Sequence
  Description of Artificial Sequence: Synthetic peptide
  N-term Napac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1489 - protein, 12 aa, Artificial Sequence
  Description of Artificial Sequence: Synthetic peptide
  N-term Pam
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1490 - protein, 12 aa, Artificial Sequence
  Description of Artificial Sequence: Synthetic peptide
  N-term Ac
  MOD_RES (3)..(3): 2-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYAAQLAS

SEQ ID NO: 1491 - protein, 12 aa, Artificial Sequence
  Description of Artificial Sequence: Synthetic peptide
  N-term Ac
  MOD_RES (3)..(3): 2-Naphthalanine
  MOD_RES (4)..(4): Alpha-Me R8-octenyl-alanine olefin amino acid that is not connected by a crosslinker
  MOD_RES (11)..(11): Alpha-Me S5-pentenyl-alanine olefin amino acid that is not connected by a crosslinker
  C-term NH2
LTAAHYWAQLAS

SEQ ID NO: 1492 - protein, 12 aa, Artificial Sequence
  Description of Artificial Sequence: Synthetic peptide
  N-term Ac
  MOD_RES (3)..(3): 2-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYFAQLAS

SEQ ID NO: 1493 - protein, 12 aa, Artificial Sequence
  Description of Artificial Sequence: Synthetic peptide
  N-term Ac
  MOD_RES (3)..(3): 2-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHWAAQLAS

SEQ ID NO: 1494 - protein, 12 aa, Artificial Sequence
  Description of Artificial Sequence: Synthetic peptide
  N-term Ac
  MOD_RES (3)..(3): 2-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYAWQLAS

SEQ ID NO: 1495 - protein, 12 aa, Artificial Sequence
  Description of Artificial Sequence: Synthetic peptide
  N-term Ac
  MOD_RES (3)..(3): 2-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYAAQWAS

SEQ ID NO: 1496 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTWAHYWAQLAS

SEQ ID NO: 1497 - protein, 12 aa, Artificial Sequence
  Description of Artificial Sequence: Synthetic peptide
  N-term Ac
  MOD_RES (3)..(3): 1-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYWAQLAS

SEQ ID NO: 1498 - protein, 12 aa, Artificial Sequence
  Description of Artificial Sequence: Synthetic peptide
  N-term Ac
  MOD_RES (1)..(12): D-amino acid
  C-term NH2
TAWYANFEKLLR

SEQ ID NO: 1499 - protein, 12 aa, Artificial Sequence
  Description of Artificial Sequence: Synthetic peptide
  N-term Ac
  MOD_RES (1)..(6): D-amino acid
  MOD_RES (7)..(7): D-Phe-4CF3
  MOD_RES (8)..(12): D-amino acid
  C-term NH2
TAWYANFEKLLR

SEQ ID NO: 1500 - protein, 17 aa, Artificial Sequence
  Description of Artificial Sequence: Synthetic peptide
  N-term Ac
  MOD_RES (4)..(4): Alpha-Me R6-hexynyl-alanine alkynyl amino acids, crosslink via a dialkyne bond with a second alkynyl amino acid
  misc_feature (4)..(11): Crosslink between residues
  MOD_RES (11)..(11): Alpha-Me S6-hexynyl-alanine alkynyl amino acids, crosslink via a dialkyne bond with a second alkynyl amino acid
  MOD_RES (17)..(17): D-amino acid
  C-term NH2
  see specification as filed for detailed description of substitutions and preferred embodiments
LTFAEYWAQLAAAAAAA

SEQ ID NO: 1501 - protein, 393 aa, Homo sapiens [sequence omitted]

What is claimed is:

1. A method of treating a liquid tumor in a human subject in need thereof, wherein the method comprises administering to the human subject a therapeutically effective amount of a peptidomimetic macrocycle or a pharmaceutically acceptable salt thereof, wherein the peptidomimetic macrocycle or the pharmaceutically acceptable salt thereof binds to a protein in a p53 pathway of the human subject, wherein the liquid tumor has no p53 deactivating mutation, wherein the human subject is refractory to another treatment of the liquid tumor.

2. The method of claim 1, wherein the peptidomimetic macrocycle or the pharmaceutically acceptable salt thereof disrupts an interaction between a p53 protein and a MDM2 protein.

3. The method of claim 1, further comprising determining a lack of a p53 deactivating mutation in the liquid tumor prior to the administration.

4. The method of claim 3, wherein the determining the lack of the p53 deactivating mutation comprises confirming a presence of wild type p53 in the liquid tumor.

5. The method of claim 1, further comprising determining a presence of a p53 gain of function mutation in the liquid tumor.

6. The method of claim 1, wherein the therapeutically effective amount is about 0.5 to about 10 mg per kilogram body weight of the human subject.

7. The method of claim 1, wherein the liquid tumor is a liquid lymphoma.

8. The method of claim 1, wherein the liquid tumor is a leukemia.

9. The method of claim 1, wherein the liquid tumor is a myeloma.

10. The method of claim 1, wherein the liquid tumor is not a HPV positive cancer.

11. The method of claim 1, wherein the administration is intravenous.

12. The method of claim 3, wherein the lack of the p53 deactivation mutation in the liquid tumor is determined by DNA sequencing of the nucleic acid encoding the p53 protein.

13. The method of claim 3, wherein the lack of the p53 deactivation mutation in the liquid tumor is determined by RNA array based testing.

14. The method of claim 3, wherein the lack of the p53 deactivation mutation in the liquid tumor is determined by RNA analysis.

15. The method of claim 3, wherein the lack of the p53 deactivation mutation in the liquid tumor is determined by polymerase chain reaction.

16. The method of claim 1, wherein the peptidomimetic macrocycle or the pharmaceutically acceptable salt thereof comprises an amino acid sequence which is at least about 60% identical to an amino acid sequence in any of Table 3, Table 3a, Table 3b, and Table 3c, wherein the peptidomimetic macrocycle has a Formula (I):

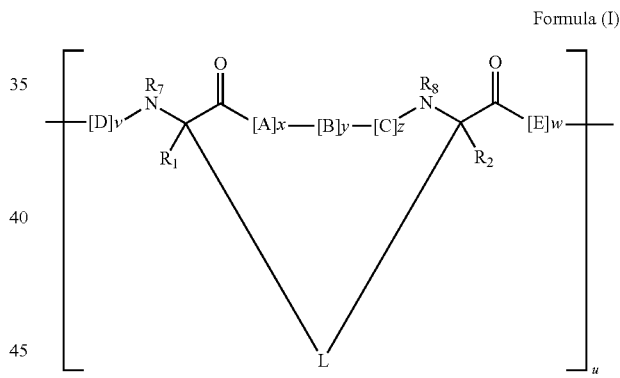

Formula (I)

wherein:
each A, C, and D is independently an amino acid;
each B is independently an amino acid,

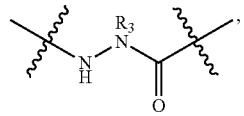

[—NH-L$_3$-CO—], [—NH-L$_3$-SO$_2$—], or [—NH-L$_3$-];
each E is independently an amino acid selected from the group consisting of Ala (alanine), D-Ala (D-alanine), Aib (α-aminoisobutyric acid), Sar (N-methyl glycine), and Ser (serine);
each R$_1$ and R$_2$ is independently —H, alkyl, alkenyl, alkynyl, arylalkyl, cycloalkyl, cycloalkylalkyl, heteroalkyl, or heterocycloalkyl, unsubstituted or substituted with halo-; or forms a macrocycle-forming linker L' connected to the alpha position of one of said D or E amino acids;

each $R_3$ independently is hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with $R_5$;

each L and L' is independently a macrocycle-forming linker;

each $L_3$ is independently alkylene, alkenylene, alkynylene, heteroalkylene, cycloalkylene, heterocycloalkylene, cycloarylene, heterocycloarylene, or [—$R_4$—K—$R_4$-]$_n$, each being optionally substituted with $R_5$;

each $R_4$ is independently alkylene, alkenylene, alkynylene, heteroalkylene, cycloalkylene, heterocycloalkylene, arylene, or heteroarylene;

each K is independently O, S, SO, $SO_2$, CO, $CO_2$, or $CONR_3$;

each $R_5$ is independently halogen, alkyl, —$OR_6$, —N$(R_6)_2$, —$SR_6$, —$SOR_6$, —$SO_2R_6$, —$CO_2R_6$, a fluorescent moiety, a radioisotope or a therapeutic agent;

each $R_6$ is independently —H, alkyl, alkenyl, alkynyl, arylalkyl, cycloalkylalkyl, heterocycloalkyl, a fluorescent moiety, a radioisotope or a therapeutic agent;

each $R_7$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with a D residue;

each $R_8$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with an E residue;

each v is independently an integer from 0-1000;
each w is independently an integer from 3-1000;
u is an integer from 1-10;
each x, y and z is independently an integer from 0-10; and
each n is independently an integer from 1-5.

17. The method of claim 1, wherein the peptidomimetic macrocycle or the pharmaceutically acceptable salt thereof has a formula:

wherein:
each of $Xaa_3$, $Xaa_5$, $Xaa_6$, $Xaa_7$, $Xaa_8$, $Xaa_9$, and $Xaa_{10}$ is individually an amino acid, wherein at least three of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$His_5$-$Tyr_6$-$Trp_7$-$Ala_8$-$Gln_9$-$Leu_{10}$-$X_{11}$-$Ser_{12}$ (SEQ ID NO: 8), where each $X_4$ and $X_{11}$ is independently an amino acid;

each D is independently an amino acid;

each E is independently an amino acid selected from the group consisting of Ala (alanine), D-Ala (D-alanine), Aib (α-aminoisobutyric acid), Sar (N-methyl glycine), and Ser (serine);

$R_1$ and $R_2$ are independently —H, alkyl, alkenyl, alkynyl, arylalkyl, cycloalkyl, cycloalkylalkyl, heteroalkyl, or heterocycloalkyl, unsubstituted or substituted with halo-; or forms a macrocycle-forming linker L' connected to the alpha position of one of said D or E amino acids;

each L and L' is independently a macrocycle-forming linker;

each $R_5$ is independently halogen, alkyl, —$OR_6$, —N$(R_6)_2$, —$SR_6$, —$SOR_6$, —$SO_2R_6$, —$CO_2R_6$, a fluorescent moiety, a radioisotope or a therapeutic agent;

each $R_6$ is independently —H, alkyl, alkenyl, alkynyl, arylalkyl, cycloalkylalkyl, heterocycloalkyl, a fluorescent moiety, a radioisotope or a therapeutic agent;

$R_7$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with a D residue;

$R_8$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with an E residue;

v is an integer from 1-1000; and
w is an integer from 0-1000.

18. The method of claim 16, L has a formula-$L_1$-$L_2$-, wherein $L_1$ and $L_2$ are independently alkylene, alkenylene, alkynylene, heteroalkylene, cycloalkylene, heterocycloalkylene, cycloarylene, heterocycloarylene, or [—$R_4$—K—$R_4$-]$_n$, each being optionally substituted with $R_5$.

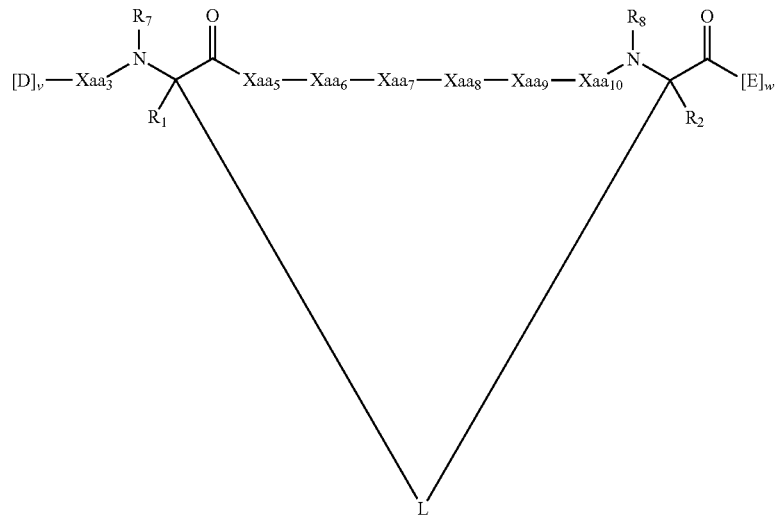

19. The method of claim 17, wherein $Xaa_5$ is Glu or an amino acid analog thereof.

20. The method of claim 16, wherein each E is independently Ala (alanine), Ser (serine) or an analog thereof.

21. The method of claim 17, wherein $[D]_v$ is-$Leu_1$-$Thr_2$.

22. The method of claim 16, wherein is 3-10.

23. The method of claim 16, wherein w is 3-6.

24. The method of claim 16, wherein w is 6-10.

25. The method of claim 16, wherein w is 6.

26. The method of claim 16, wherein v is 1-10.

27. The method of claim 16, wherein v is 2-5.

28. The method of claim 18, wherein $L_1$ and $L_2$ are independently alkylene, alkenylene, alkynylene, heteroalkylene, cycloalkylene, heterocycloalkylene, cycloarylene, or heterocycloarylene, each being optionally substituted with $R_5$.

29. The method of claim 18, wherein $L_1$ and $L_2$ are independently alkylene or alkenylene.

30. The method of claim 16, wherein L is alkylene, alkenylene, or alkynylene.

31. The method of claim 16, wherein L is alkylene.

32. The method of claim 16, wherein L is $C_3$-$C_{16}$ alkylene.

33. The method of claim 16, wherein L is $C_{10}$-$C_{14}$ alkylene.

34. The method of claim 16, wherein $R_1$ and $R_2$ are independently —H, alkyl, alkenyl, alkynyl, arylalkyl, cycloalkyl, cycloalkylalkyl, heteroalkyl, or heterocycloalkyl, unsubstituted or substituted with halo-.

35. The method of claim 16, wherein both $R_1$ and $R_2$ are —H.

36. The method of claim 16, wherein each $R_1$ and $R_2$ is independently alkyl.

37. The method of claim 16, wherein both $R_1$ and $R_2$ are methyl.

38. The method of claim 16, wherein x+y+z=6.

39. The method of claim 16, wherein u is 1.

40. The method of claim 16, wherein the peptidomimetic macrocycle or the pharmaceutically acceptable salt thereof comprises at least one amino acid which is an amino acid analog.

41. The method of claim 16, wherein the peptidomimetic macrocycle has formula (SEQ ID NO: 163):

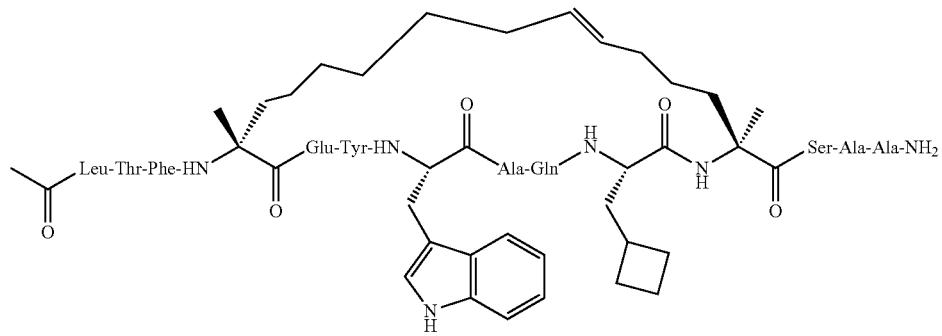

or a pharmaceutically acceptable salt thereof.

42. The method of claim 16, wherein the peptidomimetic macrocycle has formula (SEQ ID NO: 124):

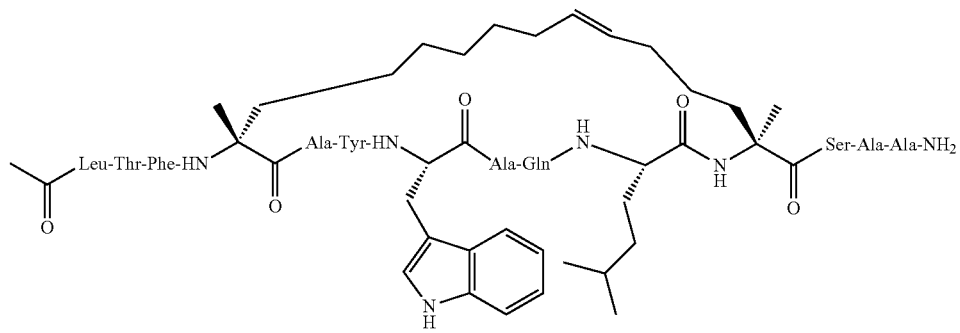

or a pharmaceutically acceptable salt thereof.

43. The method of claim 16, wherein the peptidomimetic macrocycle has formula (SEQ ID NO: 123):

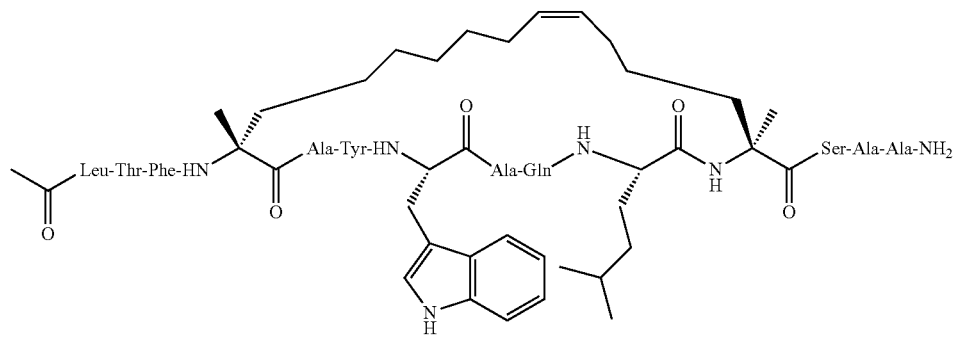

or a pharmaceutically acceptable salt thereof.

44. The method of claim 16, wherein the peptidomimetic macrocycle has formula (SEQ ID NO: 108):

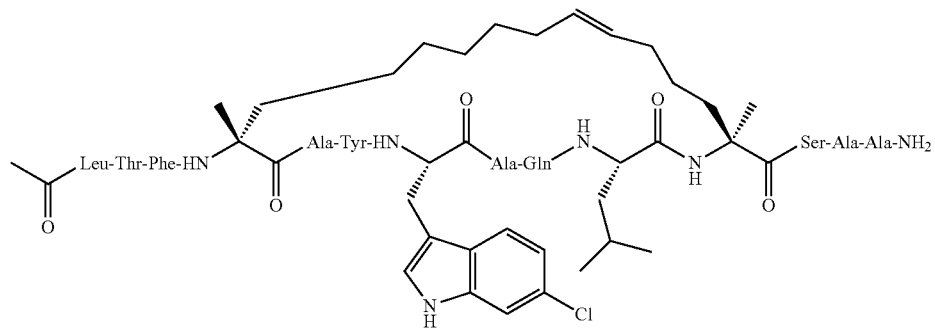

or a pharmaceutically acceptable salt thereof.

45. The method of claim 16, wherein the peptidomimetic macrocycle has formula (SEQ ID NO: 397):

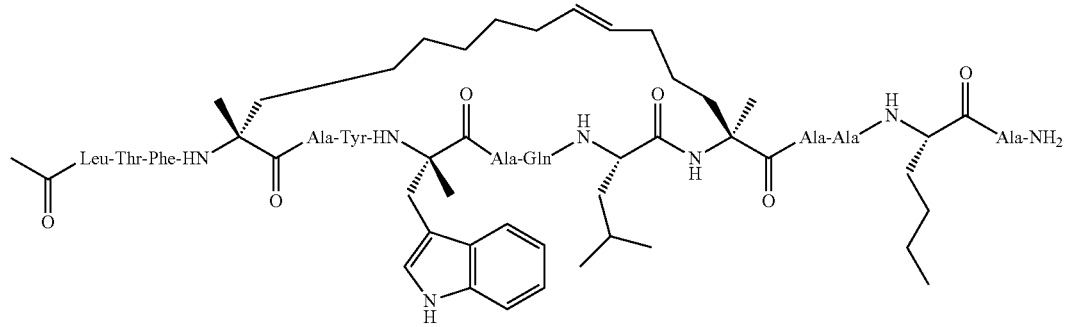

or a pharmaceutically acceptable salt thereof.

46. The method of claim 16, wherein the peptidomimetic macrocycle has formula (SEQ ID NO: 340):

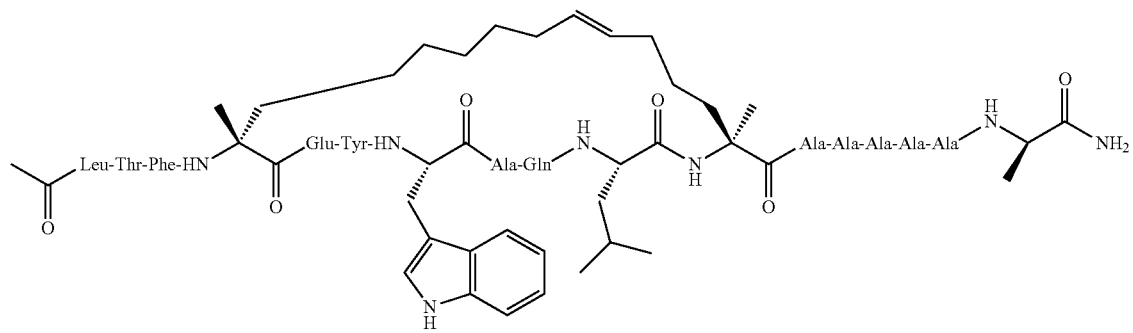

or a pharmaceutically acceptable salt thereof.

47. The method of claim 16, wherein the peptidomimetic macrocycle has formula (SEQ ID NO: 454):

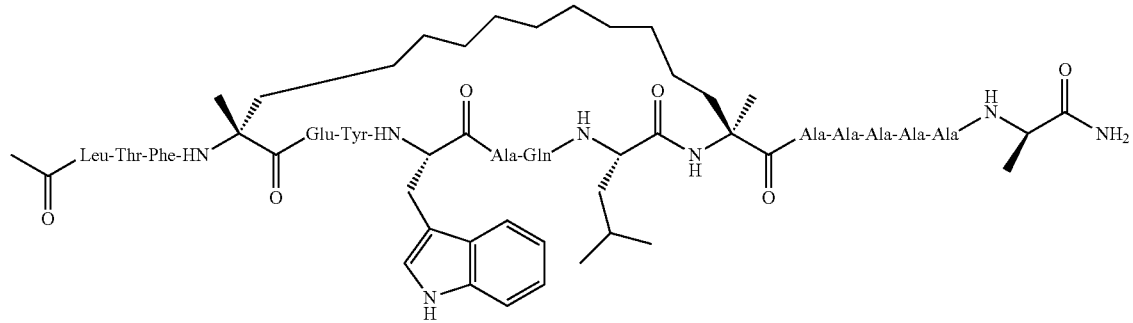

or a pharmaceutically acceptable salt thereof.

48. The method of claim 16, wherein the peptidomimetic macrocycle has formula (SEQ ID NO: 360):

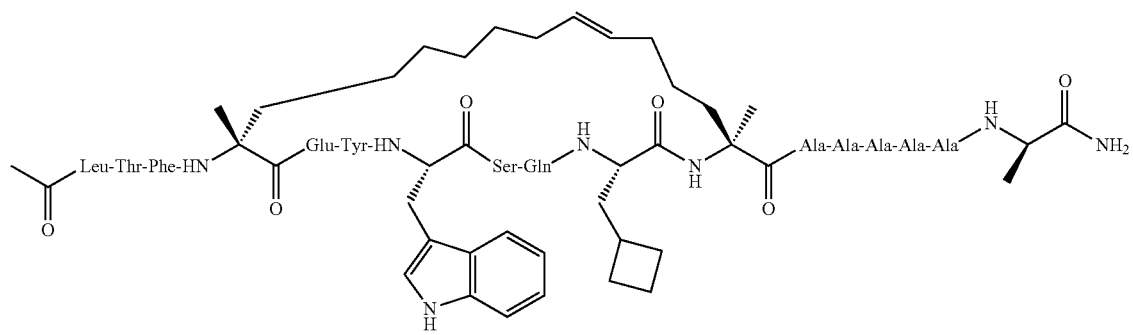

or a pharmaceutically acceptable salt thereof.

49. The method of claim 16, wherein the peptidomimetic macrocycle has formula (SEQ ID NO: 80):

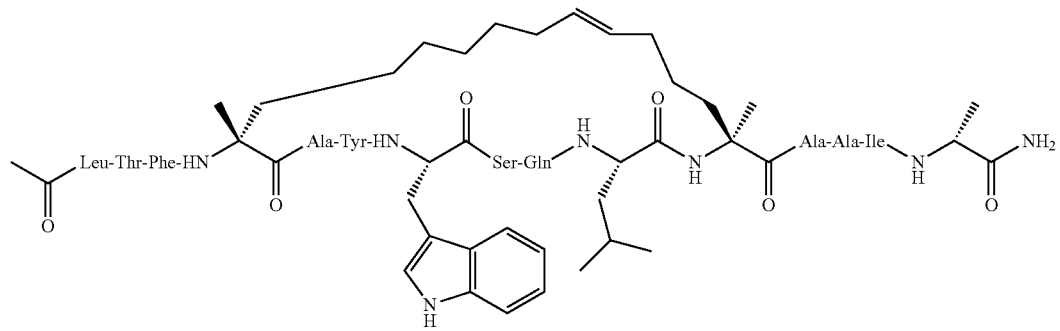

or a pharmaceutically acceptable salt thereof.

50. The method of claim 16, wherein the peptidomimetic macrocycle has formula (SEQ ID NO: 78):

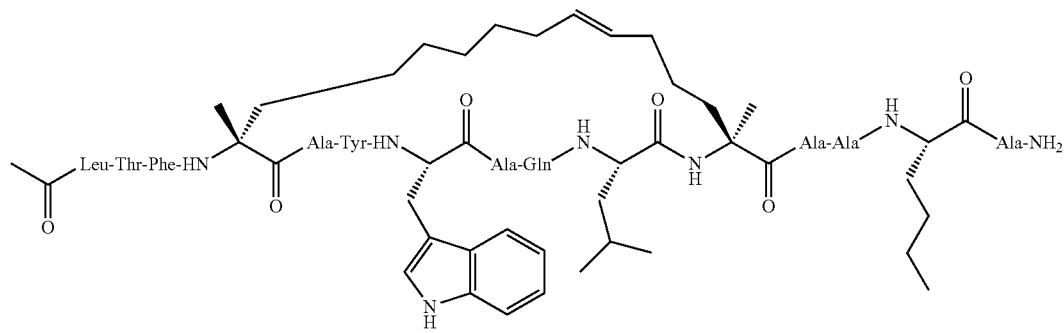

or a pharmaceutically acceptable salt thereof.

51. The method of claim 16, wherein the peptidomimetic macrocycle has formula (SEQ ID NO: 16):

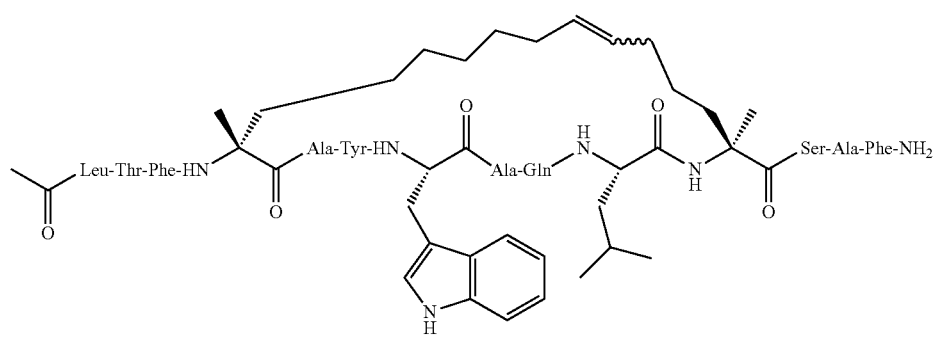

or a pharmaceutically acceptable salt thereof.

52. The method of claim 16, wherein the peptidomimetic macrocycle has formula (SEQ ID NO: 169):

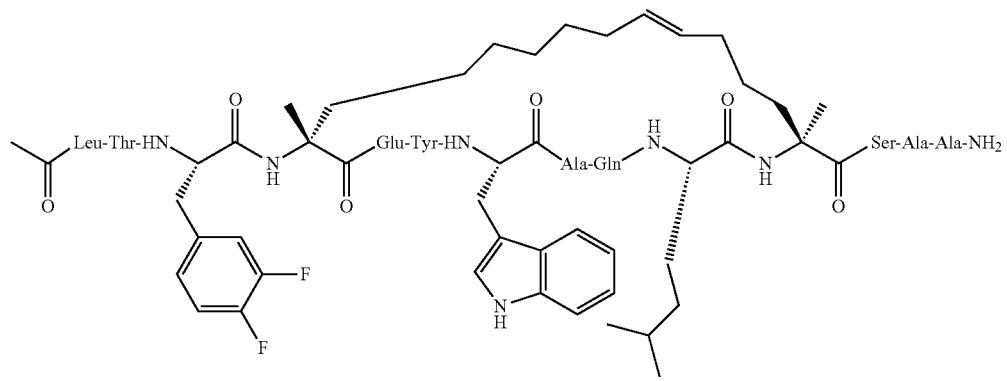

or a pharmaceutically acceptable salt thereof.

53. The method of claim 16, wherein the peptidomimetic macrocycle has formula (SEQ ID NO: 324):

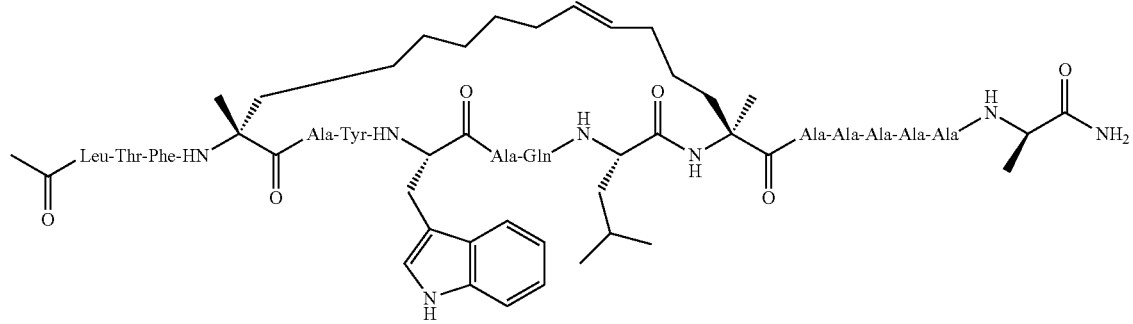

or a pharmaceutically acceptable salt thereof.

54. The method of claim 16, wherein the peptidomimetic macrocycle has formula (SEQ ID NO: 258):

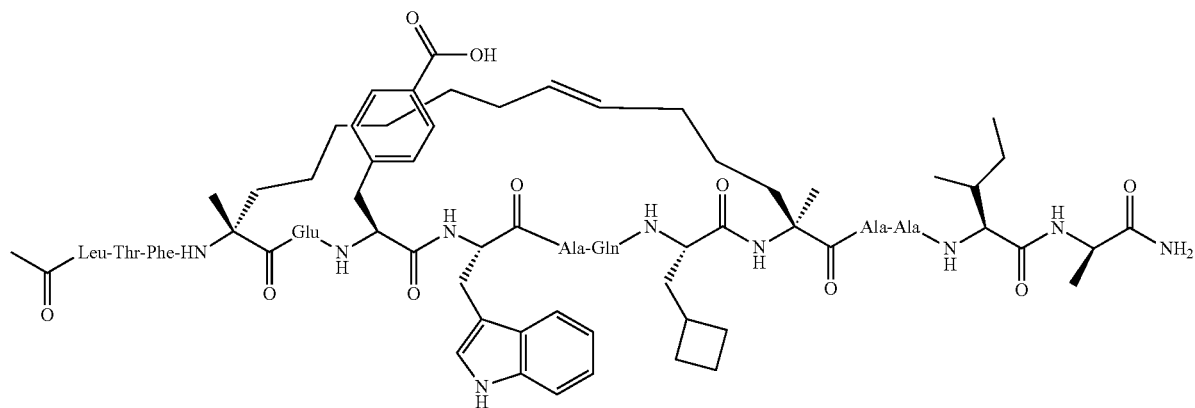

or a pharmaceutically acceptable salt thereof.

55. The method of claim 16, wherein the peptidomimetic macrocycle has formula (SEQ ID NO: 446):

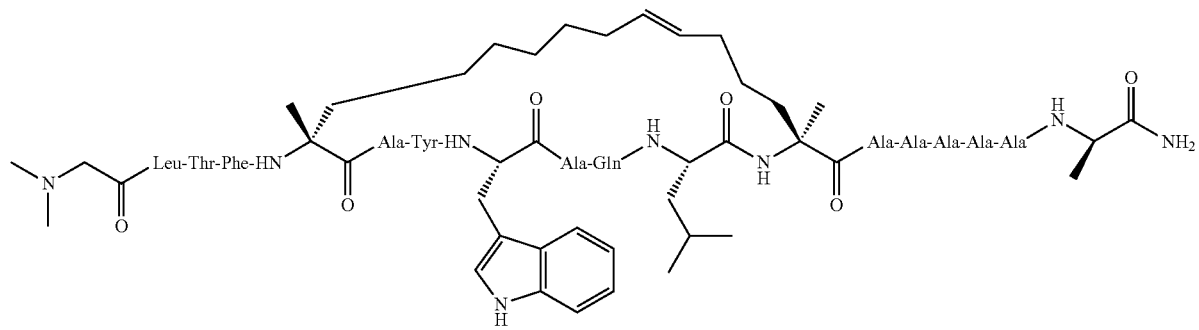

or a pharmaceutically acceptable salt thereof.

56. The method of claim 16, wherein the peptidomimetic macrocycle has formula (SEQ ID NO: 358):

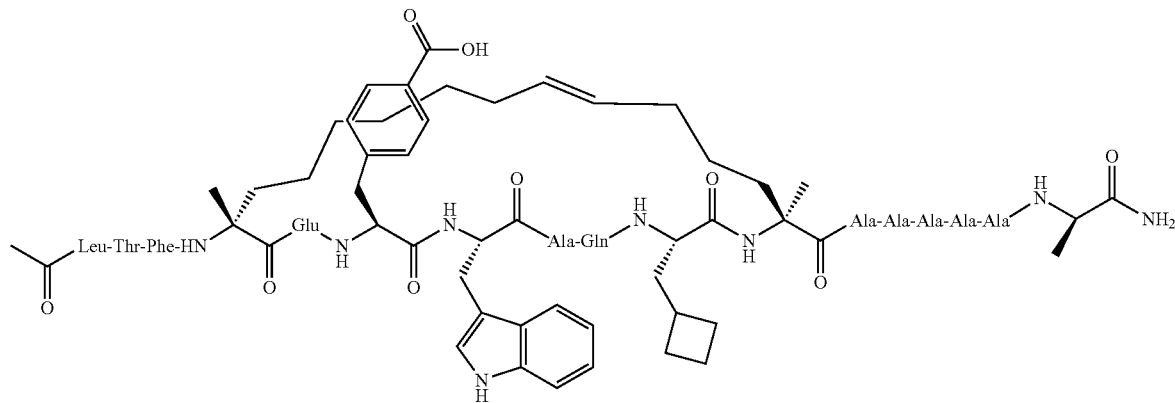

or a pharmaceutically acceptable salt thereof.

57. The method of claim 16, wherein the peptidomimetic macrocycle has formula (SEQ ID NO: 464):

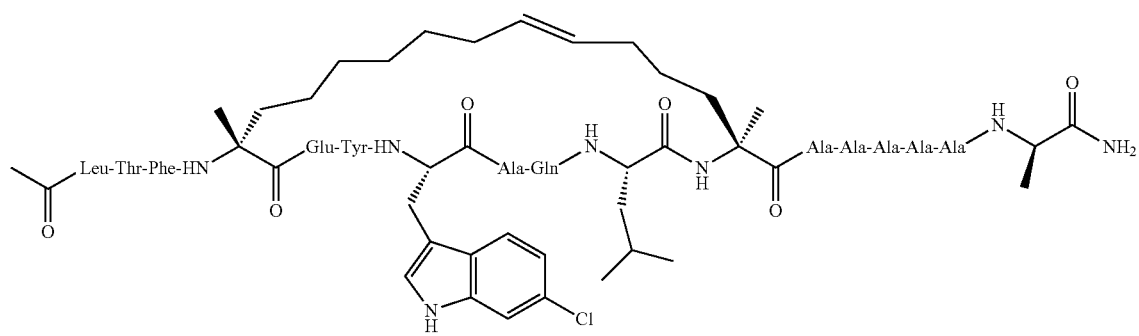

or a pharmaceutically acceptable salt thereof.

58. The method of claim 16, wherein the peptidomimetic macrocycle has formula (SEQ ID NO: 466):

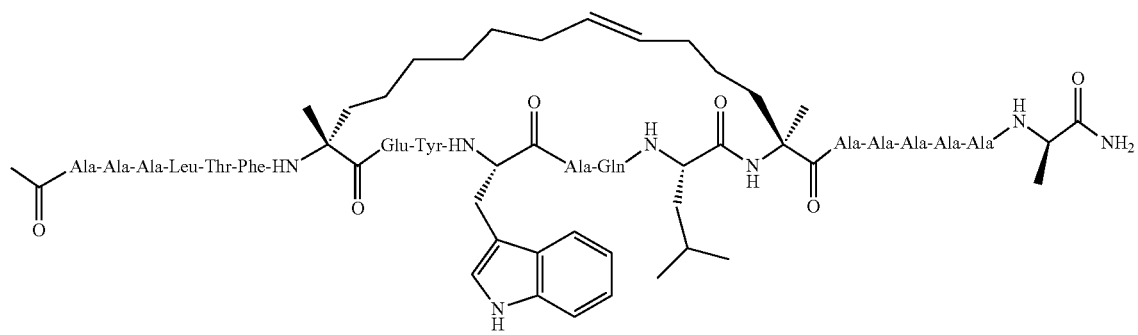

or a pharmaceutically acceptable salt thereof.

59. The method of claim 16, wherein the peptidomimetic macrocycle has formula (SEQ ID NO: 467):

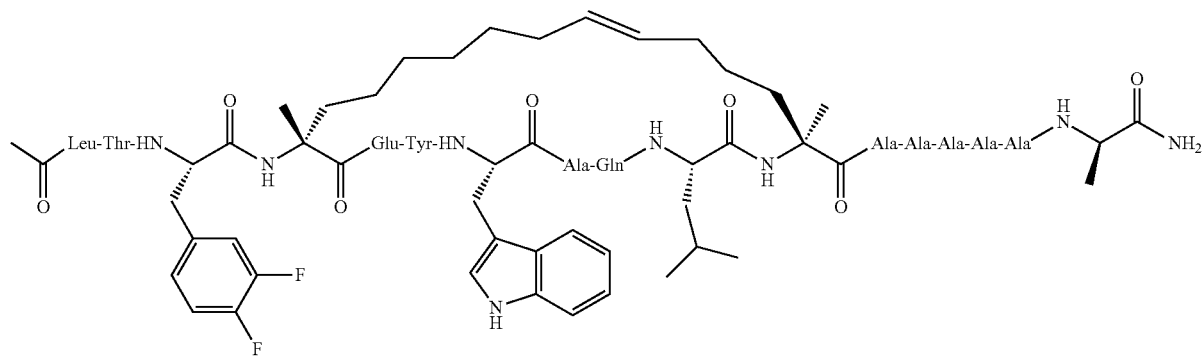

or a pharmaceutically acceptable salt thereof.

60. The method of claim 16, wherein the peptidomimetic macrocycle has formula (SEQ ID NO: 376):

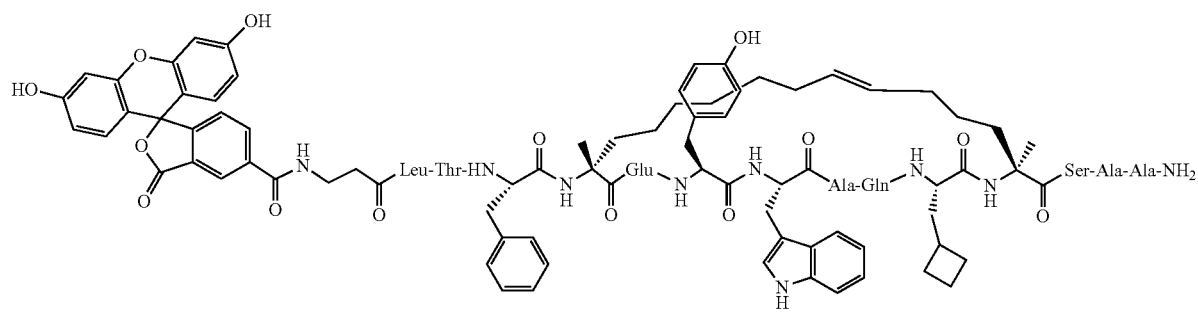

or a pharmaceutically acceptable salt thereof.

61. The method of claim 16, wherein the peptidomimetic macrocycle has formula (SEQ ID NO: 471):

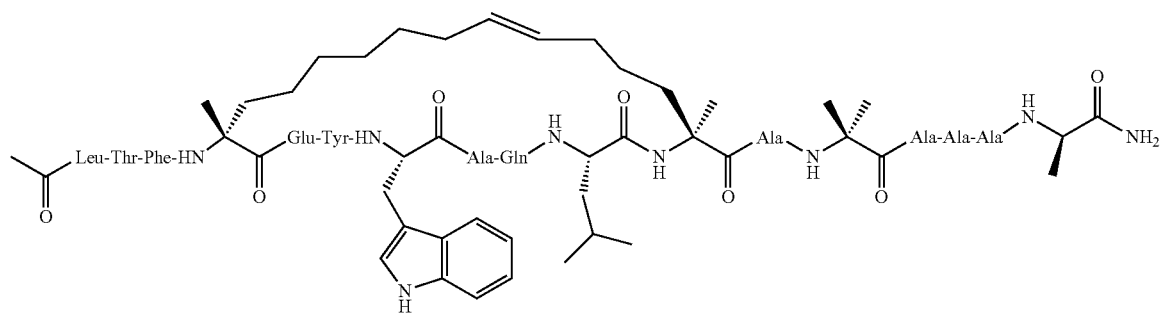

or a pharmaceutically acceptable salt thereof.

62. The method of claim 16, wherein the peptidomimetic macrocycle has formula (SEQ ID NO: 473):

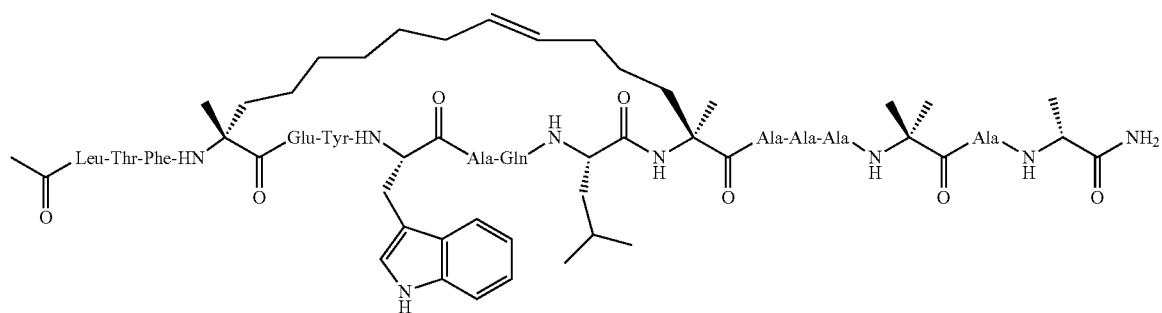

or a pharmaceutically acceptable salt thereof.

63. The method of claim 16, wherein the peptidomimetic macrocycle has formula (SEQ ID NO: 475):

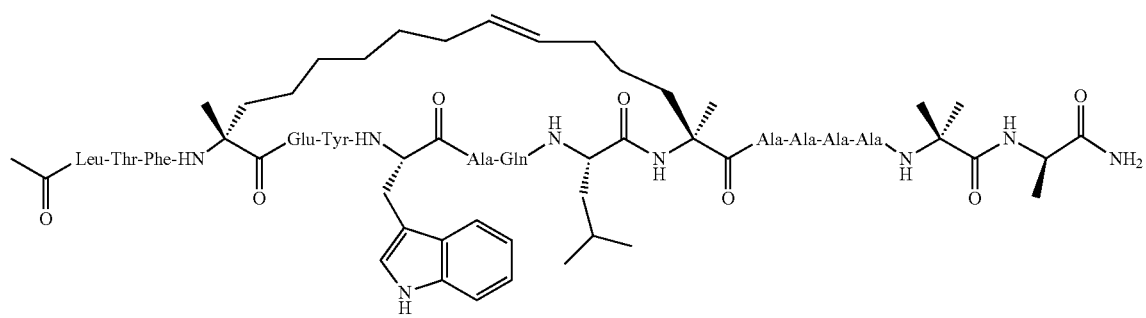

or a pharmaceutically acceptable salt thereof.

64. The method of claim 16, wherein the peptidomimetic macrocycle has formula (SEQ ID NO: 476):

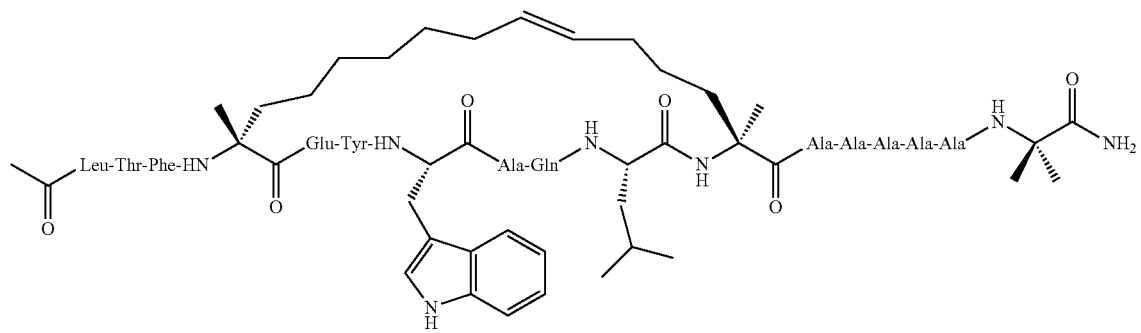

or a pharmaceutically acceptable salt thereof.

65. The method of claim 16, wherein the peptidomimetic macrocycle has formula (SEQ ID NO: 481):

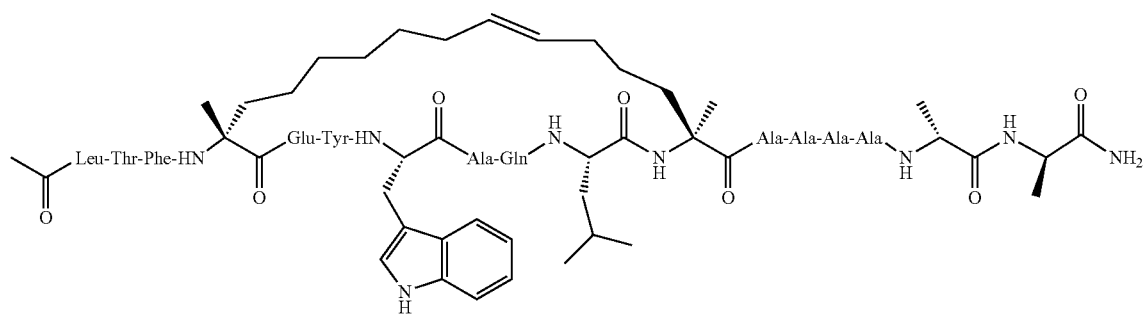

or a pharmaceutically acceptable salt thereof.

66. The method of claim 16, wherein the peptidomimetic macrocycle has formula (SEQ ID NO: 482):

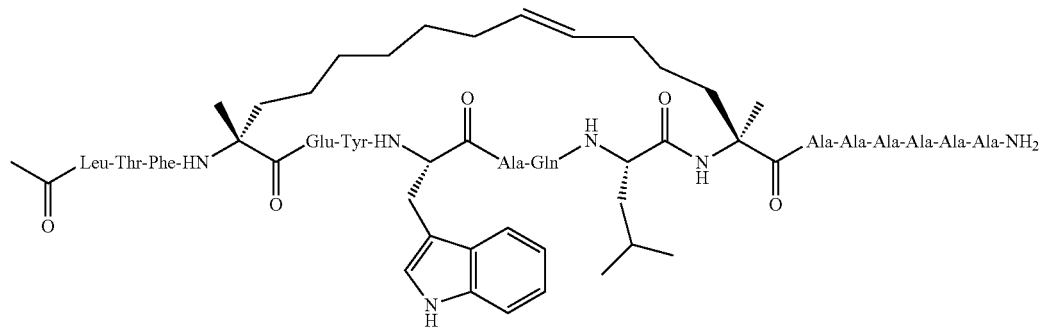

or a pharmaceutically acceptable salt thereof.

67. The method of claim 16, wherein the peptidomimetic macrocycle has formula (SEQ ID NO: 487):

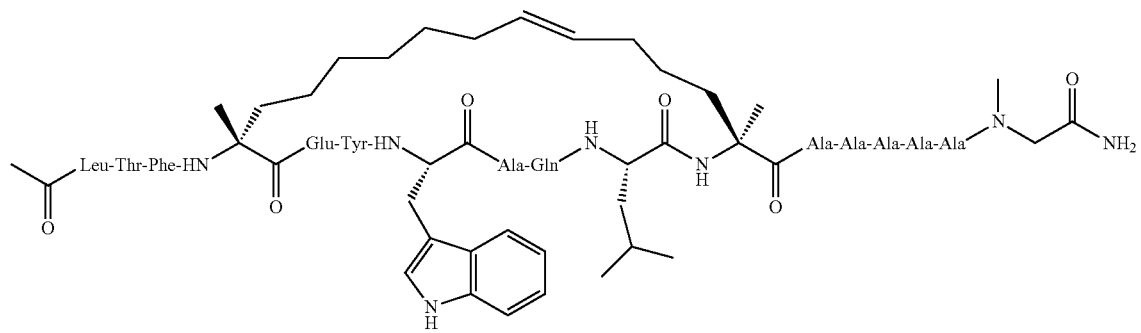

or a pharmaceutically acceptable salt thereof.

68. The method of claim 16, wherein the peptidomimetic macrocycle has formula (SEQ ID NO: 572):

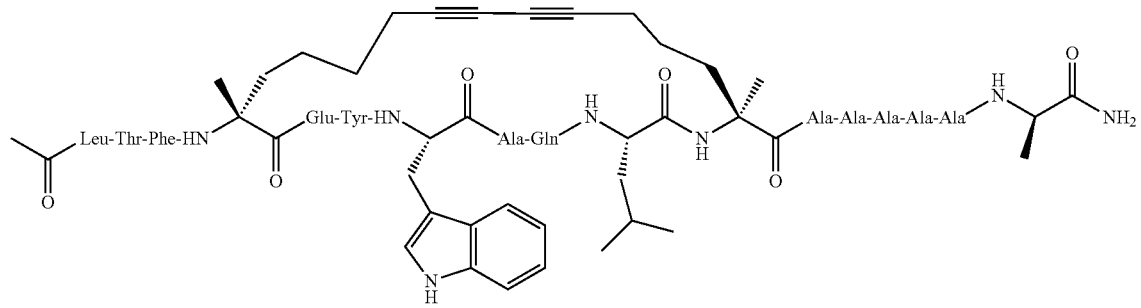

or a pharmaceutically acceptable salt thereof.

69. The method of claim 16, wherein the peptidomimetic macrocycle has formula (SEQ ID NO: 572):

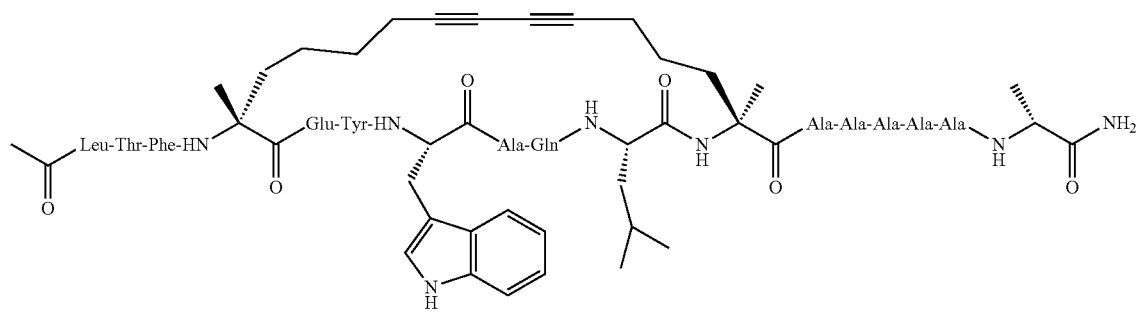

or a pharmaceutically acceptable salt thereof.

70. The method of claim 16, wherein the peptidomimetic macrocycle has formula (SEQ ID NO: 1500):

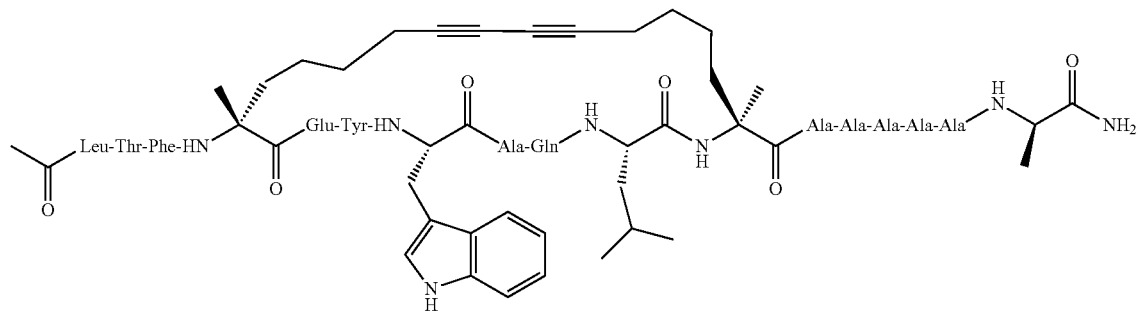

or a pharmaceutically acceptable salt thereof.

71. The method of claim 16, wherein the peptidomimetic macrocycle or the pharmaceutically acceptable salt thereof comprises an amino acid sequence which is at least about 70% identical to the amino acid sequence in any of Table 3, Table 3a, Table 3b, and Table 3c.

72. The method of claim 16, wherein the peptidomimetic macrocycle or the pharmaceutically acceptable salt thereof comprises an amino acid sequence which is at least about 80% identical to the amino acid sequence in any of Table 3, Table 3a, Table 3b, and Table 3c.

73. The method of claim 16, wherein the peptidomimetic macrocycle or the pharmaceutically acceptable salt thereof comprises an amino acid sequence which is at least about 90% identical to the amino acid sequence in any of Table 3, Table 3a, Table 3b, and Table 3c.

74. The method of claim 16, wherein the peptidomimetic macrocycle or the pharmaceutically acceptable salt thereof comprises an amino acid sequence which is at least about 95% identical to the amino acid sequence in any of Table 3, Table 3a, Table 3b, and Table 3c.

75. The method of claim 1, wherein the protein is MDM2.

76. The method of claim 1, wherein the protein is MDMX.

77. The method of claim 1, wherein the peptidomimetic macrocycle or the pharmaceutically acceptable salt thereof disrupts an interaction between p53 and MDMX.

78. The method of claim 1, wherein the peptidomimetic macrocycle or the pharmaceutically acceptable salt thereof has a formula:

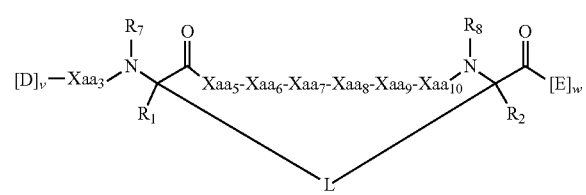

wherein:
each of $Xaa_3$, $Xaa_5$, $Xaa_6$, $Xaa_7$, $Xaa_8$, $Xaa_9$, and $Xaa_{10}$ is individually an amino acid, wherein at least three of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$Glu_5$-$Tyr_6$-$Trp_7$-$Ala_8$-$Gln_9$-$Leu_{10}$/$Cba_{10}$-$X_{11}$-$Ala_{12}$ (SEQ ID NO: 9), where each $X_4$ and $X_{11}$ is independently an amino acid;

each D is independently an amino acid;
each E is independently an amino acid selected from the group consisting of Ala (alanine), D-Ala (D-alanine), Aib (α-aminoisobutyric acid), Sar (N-methyl glycine), and Ser (serine);
$R_1$ and $R_2$ are independently —H, alkyl, alkenyl, alkynyl, arylalkyl, cycloalkyl, cycloalkylalkyl, heteroalkyl, or heterocycloalkyl, unsubstituted or substituted with halo-; or
forms a macrocycle-forming linker L' connected to the alpha position of one of said D or E amino acids;
each L and L' is independently a macrocycle-forming linker;
each $R_5$ is independently halogen, alkyl, —$OR_6$, —$N(R_6)_2$, —$SR_6$, —$SOR_6$, —$SO_2R_6$, —$CO_2R_6$, a fluorescent moiety, a radioisotope or a therapeutic agent;
each $R_6$ is independently —H, alkyl, alkenyl, alkynyl, arylalkyl, cycloalkylalkyl, heterocycloalkyl, a fluorescent moiety, a radioisotope or a therapeutic agent;
$R_7$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with a D residue;
$R_8$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with an E residue;
v is an integer from 1-1000; and
w is an integer from 0-1000.

79. The method of claim 1, wherein the peptidomimetic macrocycle comprises a amino acid sequence $Xaa_3$-$Xaa_4$-$Xaa_5$-$Xaa_6$-$Xaa_7$-$Xaa_8$-$Xaa_9$-$Xaa_{10}$-$Xaa_{11}$-$Xaa_{12}$, wherein $Xaa_3$ is Phe or an analog thereof;
$Xaa_4$ and $Xaa_{11}$ are independently a cross-linking amino acid;
$Xaa_5$ is Glu, His, or an analog thereof;
$Xaa_6$ is Tyr, or an analog thereof;
$Xaa_7$ is Trp, or an analog thereof;
$Xaa_8$ is Ala, or an analog thereof;
$Xaa_9$ is Gln, or an analog thereof;
$Xaa_{10}$ is Leu, Cba, or an analog thereof; and
$Xaa_{12}$ is Ser, Ala or an analog thereof.

80. The method of claim 1, wherein the liquid tumor is peripheral T cell lymphoma.

81. The method of claim 1, wherein the liquid tumor is acute myeloid leukemia (AML).

82. The method of claim 1, wherein the liquid tumor is a myelodysplastic syndrome (MDS).

83. The method of claim 1, further comprising administering a therapeutically effective amount of at least one additional therapeutic agent to the human subject.

84. The method of claim 1, wherein the liquid cancer is selected from the group consisting of myelodysplastic syndrome, acute myeloid leukemia, multiple myeloma, neoplasm, chronic myeloproliferative disorder, myelofibrosis, thrombocythemia, and polycythemia vera.

* * * * *